United States Patent 8,105,826 (NUCLEOTIDE AND AMINO ACID SEQUENCES RELATING TO RESPIRATORY DISEASES AND OBESITY) - sequence listing, part 4

SEQ ID NO: 3510 - DNA, 1449 bp, Homo sapiens
gcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaaatggggaaaccgaggctcagagggatttggtcactcctccagggtcacacaggctgtccacagtctggctccggggccctcctgcttatcctgcacccacagtgattgctgtgtgtgtttttcttaggagaatcccttcaaagaaaggatcgtggcggcgttttccgaggatggtgagggggaacctcactttcaacgactttgtggacatgttttccgtgctctgcgagtcggctccccgagagctcaaggcaaactatgccttcaaagatctatgacttcaacactgacaacttcatctgcaagggaggacctgggagctgacgctggcccggctccactaagtcagagctgggatgagggaggaggtgggtgcttgtgtgcgacaaggtcattgaggaggctgactttggatgggtgacggcaagctggggctttgctgaactttcgaggacatgaattgcccaagggcccctgaactttcctcaggcaattttccacatccggatctgaggacactgccgaggctgtaggggcctagaagtccacggatcctgccctgcagtcacatgggtgtggcctccaagctccccagggaaagcagtggcagccttctggggtttacaccacaaatatatcctgtgggcccttttcagcaaaaaaaaaacctttaaccaggaagggggcctgtgaaggttaggacccttcccacagccccgctgtggtccagccccgggacccatggcctctctccaggccctccgcaccccgccccatgccccagtcctttccaaagtccagaaatgctccccacgccccccaagagggaaaagcagataacccaaaccaggaggtggtggggtctgacgtgtccaagtgctggcagacaaccctggtcacccaggacagagcggaaaaaaaaaaaaaaagaggtcagggtttttaacgagctatgcaatctttttccaaaacccaaggttgggctgcttcccacccctgcctgttccccttctcccggcctccttcacgaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3511 - DNA, 1584 bp, Homo sapiens
tccgtcctctcggcttccccatgtgtgggctgggaccgcccacggggtgcagatctcctggcgtgtccaccatggccccgcagaacgccagggaccgcctgctgccaagggctcaggcatggacccctccccttctagtgcacgtgacaaggttgtggtgactggtgccgtgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgattccgtggggccccctgttgcccgccacacgcacgcacacactctttacacgagagcacattcgattccccttagggccagcgggggacaacccagccacacagggaggcatccttggggcttggccccagggcagggcaaccccggggcgctgcttggcaccttagcagactgctggaaccttttggccagtaggtcgtgcccgcctgggtgccttctggcctgtgctgccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctcttccctcctgcagatgcaagagctcctggggcaaggggtgcctggggccccagggtgtgggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccggcttcatttcagcccagggtgctcattccagggcccaagaacagtcccacctgtgctgctatgcccacagcacaaagccaggcttcactcccaaaaagtgcagccaggccctggagggtgatcctgccagcagcccatacagctccacaccctacccacccatcggcagcccctctgctgttcccccagggacctctcatacactggccaggaggctgcagaacgtgtgtctccccctccctccaagaggtccctgctcccctctgcccagaaccgtgtgtgggcgggtgggagggcgcctcggggcccggcccctccctctccctgtctggttttagttggtccctatgttggaagtaaaaagtgaagcactttattttgggttgtgtttgctcacgttctgcttggaagtggggacccctacactgcgtccacgtgtctgcgacctgtgtggagtgtcaccgcgtgtacatactgtaaattatttattaatggctaaatgcaagtaaagtttggtttttttgttattttca

SEQ ID NO: 3512 - DNA, 728 bp, Homo sapiens
gtcgacccacgcgtccggaaatctccaagtcataagacgaagaggacttcctgctcactgtaagagtcagaacaccccacaggcctgactcccttcctgtctggcttgggtggcctttacaagtaccctgtctaagctcgggagggacccgcccgtttctcagctactcccttgagcccctcaccgggcacggcgggtcttccgaggctatctacgggttttttttcaggacaaatgatgcgaaggttggtacattagtgggggaagacaaatatggaaacaaatactatgaagacaacaagcaattttttggccgtcaccgatggggttgtatatactacctgaaatgaatgggcaaaaacacatttttgggatgtggatggaagcatggtgcctcctgaatggcatcgttggcttcacatgtatgactgatgatcctccaacaacaaaaccacttactgctccgtaaatttcatttgggacggaaccattaaatttcaacgtggactggggcaccccaggaacaatatgtaccttattctaccactagaaaagaagattcaggagtggatcccaccttcaacaccttacaagtaaagacaatgaagaacagttgaaacatgcaaaatatggagcttttcatgtaattactcttttactgtttaccattcactataattcacaattaaaattgtgtgactaaaaaaaaaaaaaaaaaaaagtcgacc

SEQ ID NO: 3513 - DNA, 574 bp, Homo sapiens
gccgaggcgcttctgccatctgtgggccgagcattcttcaggtcatctgcaccgtctgcctgggaaaagatggtcaacgtgctgaaaggggtgcttatagaatgtgatcctgcccatgaagcagtttctgctgtacttggatgagtccaatgccctggggaagaagttcatcattcaagacattgatgcccactcacgtcttttgtaatagcagaatatgattaacatcctcacaggagcggagtgggtgaattaatggaccaaaatgctttttcccttaccccagaaatggaaaaatactcaaatatggacccattcaggaattaataagcagcaaatgtgaaaagacttgccactcgatatatatagaagacagattagacgtagagggttgtttatagttgatttaggagcatgccacggggaaagactgagggatcatgatcatttgttcagaaaaaaagcccctgaactgattttgttataccatagaatttaaaaaaaaaaaaagctttaacagttggctgtaatttggcttttattatcctttattaaaatacaaatgtcaatgctt

SEQ ID NO: 3514 - DNA, 475 bp, Homo sapiens
gttgtggtggaattcctgtcccgctgcgtgttttccctcttggatcggggaactcctgctttctccttgccctcgaaaatggacccccaaactgctcctgctcgcctgttggctcctgtgcctgtgccggctcctggcaaatcgcaatagagtcgcaaatcgcaccgtcctgacacagacgagctgctgctcctgctgccctgtggcgtgtgcatagctttgcccagggctgtcatctgcaaagggacgtcagacaaagtgcagctgctgtgcctggatgccagggacagctgtgctcttcagatgtaaataagagcaacctatattaaacctgggattttttttttttttttttttttttgtacaaccctggacccgttttgctaacatcttttttttctatggaaatatgtggaatgggcaataaattcttttagcctaaaaaaaaaaaaaaaaaaaaaaaaaaaaaaaaaaa

SEQ ID NO: 3515 - DNA, 737 bp, Homo sapiens
ggcacgaggttccccagcatcctgatgtgtcccctctccccacttcagaggccacccactcagcaccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccatttgccaagccaggaaggcagctttcgcttgttcctgcctcgggacagccccgggtttcccccagcatcctgatgtgtcccctctccccacttcagagggccacccactcagcaccacgggcctgggccttgcctgcagactataaactataaccacttagctcgacacagtctgcagtccaaggcgtgtgggagccgccttcccggctcgggggaggccccgggggctgggaaacgcttgtgccttcctgcgccgaagccaacgccccctctgtccttccctgggccctgctgccgaccagggagcttgcccagccctgtgggcgttgcggccttccctccttcgctcctttttttatattagtgattttaaaggggactcttcagggacttgtgtaactggttatgggggtgccaaaggcactaggcttggggtggggaggtcccgtgttccatatagagggaaccccaaataataaaaagggccccacatctgtcaaaaaaaaaaaaaaa

SEQ ID NO: 3516 - DNA, 3245 bp, Homo sapiens
tttttttttttttttttttttttttttgggttcaaaaaagtacagggttgacattttattttttatgtaaagaagccatatttacataatacattcatatttttaagtatgttacagctcctgtagaaaaccattccattaagacagcaacaagtgaatctggattcaatctttaaaatattaagtccaattaaaatgttccttatcaaaactcccaatttaatttcacagcccattttgcacaggggaactgagggagaaacaggaatgaaagagtgggcgaacaaagaagaaaagcatcccttcccacacgcccaagagtccagtgcaacgatccctgccacacggtcagccgaccccacttggtgccacagggtccagcctcgggccacttctgggctcaacctttccagcacgtctggggagccccaattgaaggctatgggacagtgtgcatttccctcaaggcctccggaaagtcacctgccacccactgtgaccttctgaggctgaaaggacttaaggactcttttcccaatcattttcagctgggccagtggctgggctaaaatcagcgcagcatttcccattcttctgaaaagccacagctgaaataatgcaccagctgaaaaccaccagtggagagacttgagatgggcctccctctgggcctctagttggcaactttctcacccgggggctcctctttctccttttcccgctccttgttccagtccttaaggccttctggaagtgaggtgtcctcatccaagctgccagtgccttccacaaattcttcataggtaagatttttccgcaaatggtctgggggccaaaaagttcaaccatatcattcctaaccaatacttctttttctaacaacagaagagcaaccttctccacgtcagctttcttttctgtgagaagagctactgttcttttataagcatcattaataagtattcgtacttcatcatctatcaatcttgcagtggcttcactgtaaggtttctccaactaccactgctcccctgacgtgggaggtcaaaggagatttgcccaaccttttcattcatgccaaactgaaacaaatttgggcataatggcactctgaagttaacttttcacaagtcatcttgagcaccagttgtaattcttccaaagaagatttcttcagagactcgaccacctaaagtcatacacatcctatccaagagctgctctttggtatagaggtattgttcttttggtaaatactgagcataacctagtcctttgccacgtgggatgatggatacctttaaaagcgggtctgcgtgctccagataccagccggcaaccgcatggcctgcttcgtggtatgccacagtcttcttctcctcaggctgcagaacctgcgttttcttctctaagccaccaatcactcgctcaattgcctgttcaaagtgtttctgatttatggaatctgacagatgccttgcagcaatcaacgcagcttcattacagacattagcaacatcagcacctgaaaaccctggagttaaagatgccagttttcttgccaatttatccttctccagggtactgtccagttttagcggtcggagatgaactttgaaaatagaagctcttccttttatgtctggtggtccaataaagatctgcctgtcgaaacgccccggcctaagtagcgcggggtccaggatatctggtcgattggtgccggccaaaatgacgacatttgttgttgtattaaaaccatccatctccaccagcagctggttgagtgtgttctcctgctcactctgccctccaaagttgcctcttcctctcttccttcccaccgcatcgatttcatcgatgaagaggatgcaaggggcattcttccgagcaagggcaaataagtctcggactctagcagggcccacaccaacgaacatctccaaaaactcagatccactaacggtgatgaaggggacattggcttctccggctgtggccttagctagcagcgtcttcccagtgcctggaggaccagtgagaatggcaccctttgggatttttgctcctaggtcttgatactgctttgggtttttcaagaaattcacaaattccatgatctctagcttggcctcctcacagccagccacatctttgaacttcacatcaatttcatcctttaagaccttggcagtggtttctccgacactgaagagtccgcccatccctcggcctgtccggccaatgccagcaggccctcttctgatggtgtagagcaagaaggcgatgatgagcaccgtaggcagcatgctcagcagaaaagagccatcactttcagcaatgtagacaacaggcacccgattttctccttctatgcccaattcctgctgtaaagtttccagattccgttcaaaggtgtccacactgccaatattaaaccaaacgtattgcccatcaacaggagtttttcctggtgtaaaggtcactcgaacaaaacgcttgttgacgacttccaatctgtctactactccttttgaaagatagttattgacaaagtccttccaagtgatttctctcccggatctcttgagcagcaagtaaaacatgactccaccccagaacagagcagtccagaggaagaacatcctgaaatccttgtcgtcccatggaatgtcacccttctgaaacctggaccaccagtgagaatcatctttcttgccacctcgttttccaccgccaccacctcctcctccagaagagcgtgtggtagcagctggctttgattcttttttctctcccataacttctttaggttcactagctttttttccattttttccattaggaaagtattttccaaatccttttgggggtcgagaacagaatctttgataagcagcaattatatctgtcaaaagagaatttctgctggcccttgcttgagttgtaacaaatcggtaaagcgtccggaggcagggctgctcgcccgggcccacgccgccaggcacgaggagctgctgtaggccgcggggccagcagccgccccggccccacagccgcaaacagcggtgcgccatggccgccgccgtggccctctcggcccgggacgctgcgcaggcgcgggcaggcgacgactggcggcctcgggaagcgggctcggctcggggaaaggccgccaggcagcgaagcgcgccggcggctcacggaggagcccaagctctcaacgcggcgtctcccctcgtgcc

SEQ ID NO: 3517 - DNA, 1789 bp, Homo sapiens
  misc_feature (1)...(1789): n = A,T,C or G
tccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctaattggctggtagacaacgtgatccgttggttttggagtggtgttcgtggtcctggtgatcgtgctgacaaggctccattgtagctatcgcctacctgtgtgtcctgcctctcatcctcccgaacctactcaagtgccacgactctgctggcatttcttctataagccactggaaatctgaatcctgatttgtcttccactactaccaggccatcaccactccgcctggggtaaccaccccagggcaggaatgatatcgccaccgtctccatctgtaagaagtgcatttaccccaagccagcccgaacacaccacttgcagcatcttgcaacagggtgtgttgcttgaagatgggatcaccactgccccttggcttaaacaattgtgtgggccactataaccatcggtacttcttctctttctgctttttcatgactctgggctgtgtctactgcagctatggaagttgggaccttttccgggaggcttatgctcgccattgagacttatcaccagaccccaccacccaccttctcctttcgagaaaggatgactcacaaggagtctgtgttttacctcttggttcctgttgcagttcttgtggcacttgccctgggtgccctaaactgtatggcatggtgttctcatcagtcgaggttgagactagcatcgaaaggcacatcaacaagaaggagagacgtcggctacaggccaagggcaggagtatttaggaatccttacaactacggctgcttggacaactggaaggtattcctggggttttggatacaggaagggcactggcttactcgggtgtatcttaccttcttagtcactttgccccatgggaatggaatgagctggggagccccctccctgggtgactgctcactcagcctctgtgatggcagtgtgaagctggactgtgtcagccacgactcgagcactcattctgctcccctatgttatttcaagggccctccaagggccagcttttcctcaaaaatccttgaatccaaaaaagagccagtgggcctgccttaagggtacccatgcaggganaatttcaaggaccagccctttttacccactgcagaagaaagacacaatgtgggagaaatccttaggacttgacatccctttattcagggcaaacagaagtttccaaccccagatttagggggttcagggcagctagcttacctaccttggcccagtggttgacccggacctcctcccaggatacagcactggagttggccaccaccctcttctacttgctgtctgaaaaaacacctgactagtacagctgagatcttggcttctcaacagggcaaagataccaggcctgctgctgaggtcactgccacttctcacatgctgcttaaggggagcacaaataaaggtattcgatttttaaagataaa

SEQ ID NO: 3518 - DNA, 1488 bp, Homo sapiens
cggccgcccttttttttttttttttttgatgttaatgactttactttgagatatgatggaaaaatattacaggtacacatggaaaagacatgatcaccaagtgaaaacaatctaaccagaaagctttaacatctgtcagttaagctgaagctgaaattctgggagcatgacatgctggaggggccaaaaggaatggataattagtattcctctccttcttcctcaccctctccttcaacagaatccacaccaaaccttctcataatcctttctaaagggcagccatatcttcacgggcctctgaaaactcgccttcctccatcccctgcacccaggtaccagtgaacaaagggcacgcttggcataacatcaggtcaaacttgtggtccaggcgagcccaggcctcagcaatggctgtggttgttgctcagcatgcacacagctctctgtaccttggccaggtctccaccaggcacccacagtgggaggctggtagttgatgccaaaccttgaagccagtggggcaccaatccacaaactggatggctgcgcttgggttttgatgggtgggcaatggcagcatttgacatcttttgggaaccacgtcaccacggtacaacagggcagcaaggccatgattttacccatgggcgagggtcaccatttcacccatctggttgggctggctcaaagcaaagcatttgtgatctctggctacagaaagcttgttccatgggtaggctttctgtagcagagatcacaaatgctttgcttttgagccagccaacccagatgggtgaaatgtgaccctcgccatggtaaatacatggcttgctgccctgttgtacccgtggtgacgtggttcccaaaagatgtcaatgctgccattgccaccatcaagaccaagcgtacccatccagtttgtggataggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatactaaaggttaaaacgtccccaaggtggctgcttttacagggaagcttattctgttttaaacattgaaaagttgtggtctgatcagttaatttgtatgtagcagtgtatgctctcatatacaattactgacctatgctttaaaacatgaatgctttgttacagacccaagctgtccatttttgtgatgggttttgaataaagtattaacctgtcttaaaaaaaaaaaaaaaaaaaaaaaaaaa

SEQ ID NO: 3519 - DNA, 1001 bp, Homo sapiens
gaacatgatggccgcctgcgattccgcgccatggccgctacctgaccgtggccaccgtgttccgcgggcccatgtccatgaaggaggtggacgagcagatgctggccatccagagtaagaacagcagctacttcgtggagtggattcccaacaacgtgaagggtggcccgtgtgcgacatccgcccccccggccctgaagatggcctccaccttcatcggcaacagcacggccattccagggagctgtttcaagcgcattttccgaggcagtttctcaggccatgtttccgggcggcaaggcctttcctggcactggtttcacgggtgagggcatgggatgaaatgggagtttccccgagggcggagagcaacatggaacgacctgggtattccgagtaccagcagtaccagggatgccaccgccaatgacggggggagggaagctttttgaggatgagggaagagggagatcgatggatagttcggaattagagccgcccccaactcagatcctacaacacggcaatttccttctttgaacccctggtgccctcccctaccccctatggccccctgaaagggtgccacctgggtttaattggtggttgggtgtcgggcccccctcacaaatgccagcccaagtccatgtaattaagccatcctgggaacaaagacctaaaaacagcaagagaattgccgggttcctaccccagtcagaagatcaccaccatgggagactttcctactagagggacttgaaaagagaacctgaaggggccacaaaaataaacttcacctttccatttaagtgtttcaggcatgtctgccaaattagggaggggagttagaaacagtcttttttcatccttttgttgatgaagcctgaaattggtgccgtgttggccttatatgaatatgcaggtatgggactttgaaataatgattcataataaaatactaaacgtgtgtcttcatctctctaaaaaaaaaaaaaaaaaaa

SEQ ID NO: 3520 - DNA, 3471 bp, Homo sapiens
  misc_feature (1)...(3471): n = A,T,C or G
gcctgcctcttccagagagactcccccattgctgtctcttgtgtgtgtcatgcacaaggaaggcttggttgtgtgccaggataaggggcacaagggcctcgggtgtggccagagaccccatgcttaagcttttatggtataggtcaggctgcaggggtttgagggcctcagttgtatatcagaatcttcagagcactgcgatgttcaggggtgagtcaggtctgtagatgtgcacggggtcttctgaagggtcagtttctgtaatcactttcaggtgtgtcagggccttgtgcagtaacagtgcacacagaagttagtgtttctgtgggctaagggttgtagctctgtatcaggattctgggagtgggtctggatttctggtgtgtggacttaagaagctgtgtcagacttgggggaggggcgttcatgtataactgggttcacataggccaagactcccaggtgcattttaggcagagcctcaggtgtgttagaggtcccaggggcagagaggctataggtgctgtcagaggccttggggacatttagggcagagcctcgagtgacaggtcctgggacagtgggagccaagggcaagtgctagagttgcagtgaatttagagcaaagcctcagctaagtgacacatcccagggcagtaggggatctatctatgttcagtgcgggcctcacgttaattgaccagccttatgaacaatggcggctgtggcatgcgtaaggttacccgccttaatatgggatcgtgaaaggcccctccctatgtgcaggagacaagcagccaaagaaacaggagaaaaacccagtgttggtgtccccagagtttgtggatgaagctctgtgtgcgtgcgaggagtaccttagcaacttggcccacatggacatcgacaaggacctggaggccccgctgtacctcaacccccgagggctggtccctcttcctccagcgctactaccaagtggtccacgaaggggcagaactcaggcacctcgacactcaggtccagcgctgtgaggacatcctgcagcagctgcaggccgtggtaccccagatagacatggaaggggatcgcaacatctggatcgtgaagccaggagccaagtcccgcggacgaggcatcatgtgcatggaccacctggaggagatgctgaagctggtgaacggcaaccccgtggtgatgaaggacggcaagtgggtggtgcagaagtatattgagcggcccctcctcatctttggcaccaaggtttgacctcagacagtggttcctggtaactgactggaacccacttaccgtgtggttctaccgcgacagctatatccgcttttccacgcagcccttctccctgaagaacctggacaactcagtgcacctgtgcaacaactccatccagaagcacctgggagaactcatgccatcggcatccactgcttccgccagacaacatgtggtcttagccagaggttccagggnccacctgcagggagatgggtgccccaaattgcttggtccaccatcatcgtgcctggcatgaaggatgctgtgatccacgcacttcagacctcccagggacaccgtgcagtgtcggaaggccagctttgagctctatggcgctgacttcgtgttcggggaggacttccagccctggctgattgagatcaacgccagccccacgatggcaccctccacagcagtcactgcccggctctgtgctggcgtgcaagctgacaccctgcgcgtggtcattgaccggaatgctggaccgcaactgtgacacaggagcctttgagctcatctataagcagcccgtcaccacttccccagcctccacaccaagggcccagctgccttctccccatgtacttcgacaccagggccaggtcctcagacggacagcacagcaagctgggtngggcactaaggccctgttcggaccacagggcaagggctttgaggacttttacccacgggttaagggttttcattttccttcccaccgaaccttgatttcagggtggcacccagcatcctgaagccaagaaaggtgggcctcgacctgtgactcacacccagtggacagtgctgagcacggggtcagggctggagggcacaggcagagggcagctccccaggctggctggcaccccaaggggaagagctggtctcccttcaagaagccccttcttccaacagacttctgatcatctcccctcttctccccctcctttcacaccggagggctcctgcttctcctgtgcctccgaggcccccagctggaagtgccttgttgcctctgccctttgaagtcggaacaattcactagcacctgtcggaaggtcaaggccaaaggcaaattcaaggccagactgtgacaaactccagggctgaggcctgccccatgaagaggctgagccccctgaaacccctgccccttgttggtacattccagaggcgcaggggcctgggggatatgaagctcagggaagcccctgcttcgatttccccactgcccttgtcctggatccaacaccgaaataaaaagaaacaagtgaagtatttggggcttggactccattgctgttggagggtcaagagtggatggggcgaggccgtgtaccccagggtccacagcaagagcctgaggccatcagcagctcctccgtgcagcgaggcccagaattcccacctaaggacagacatggggcttcctatttagggactcccccagcatctccgatccaggggtggggagcgtgagccttcactttacagatgaagaaactgagtctgaaagaagaggcatggcttacccacgaatcaccnttggcaaggagtcgacgcaagggacatattggcagaactgccgagcactgggagccccccaaccccagagaacaagccaagctagcagaatgacacctaccgggcataggaacgttaatgccatgagacaagggaaggaattggccttgcctaaacctcagcccttctgcagagggcatgggtctatcccttcttcagcaaggggccaaggtcacctaaaaatgaaacatccaataagccacacccacctgaagaaaagtgtggcactgcttagttgtaagtgggttgaactgtggtcccctgaaaagagatgtctacttggaccctgtgaatgtgaccttatgtgggaaaagaagtctttgtagctgggtatggtggctcacacctgttatcccagcactttgagaggccaaggggcaggagatcgcttgagcccacaagttcaagaccagtctgggcaacatggtgaaaccgtttctacagaaaattagctgggtgtggtggcacacacctgtagtcctagctactcgggaggcctaggtgggaggattacctgagcctgggaagatcaaaactgtggtgagctgtgatcacgccactgcgctctgagcctgggagacaaagtgaaaccct

SEQ ID NO: 3521 - DNA, 1763 bp, Homo sapiens
  misc_feature (1)...(1763): n = A,T,C or G
gagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacgggggacctcaaccacctggtgtcggccaccatgagcggggtcaccacctgcctgcgcttcccgggccagctgaacgccgacctgcgcaacgtggcccgtcaacatggtcccctttcctcgcctgcacttcttcatgcccggcttcgcaccccttgaccagccggggcagccagcagtaccgggccctgacggtgcccgagcttcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaaggaacagcagcttacttcgtgggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgagtccagagagcaacatgaatgacctggtatctgagtaccagcagtaccaggacggccacggccgaggagggcgagttcgaggaggaggcggaggaggaggtggccttaggttgctcccatcgcttcccacctgtcccctcgaggctttttaacctttgattccgttaggccccccatcttttgaaccctagagccccgctttccctccaaggctgactcccccctgaccctaacaatacctttggagctcgctttacctctggctacttcatctccgaccctggctcccctttgagccctaatttatctttaacccccttgagctcttccaaccttggacattcccagggaggagccccggcttcaccccttctcactctggaaaccgcacctttaactttgcagaccttcctttcaacccctgacttctgcttcacctttgcacctctggccccccatgaattcccattttacctctaggacctataagttctggtttatgtttgaacccctccctctgaggctggcacttcacccgctgaccttgcctcacctttaacccccccacctgaggccccaggctcctacctctggaccccaaacttctctttggatctctggaatccccttctggactccaaacttcttctttcaccctctatgagtccccattttacttctaaaacctgcaagtcctggggttaatattggggaccctttcctccgaggtggcagttcacctttggaccttggccttcaccttttcaaccccccaccccccacagggttagttcctgacctctggaaccccaggttttttttggggttcccacaggccccatgcatcctccctgcctcactcccctcagcccctggcgnaccttagcttatctgggagagaaacaaggcctggtgcctgtgaggaagagaggtcacccctaccctccctccccgcttgcctgcctcaccctcaataaataaattaattgttgtcatgg

SEQ ID NO: 3522 - DNA, 4214 bp, Homo sapiens
tccttttattgtggatgaacaccacgtacatgccgtaaatgctccctaggctggctgcggctacaaggcagacccgggagctgagaatagaggaatacctgcccaagcaactcattctgcacagcagccgacaagatagcgattttcctgtgctggaatgtgcccatccaaagacacttggattggacttaatcttaaacctctggagttcaagaccttttaaaaagggctaaataaacaatctctacatgtaaaaaggccacttgactcctacttccctctggtaatagagccaacttgtttggaactcagctggcctgtagggcgtgattctcagtcaccagactcagcttggagatcttacaatgatggcaatcaggagacactgaacggagatgctacatattcctctcttgcagcaaaaggttttagaagcgttcgaccaaacctacaagataaaagatcaccaactcagagccagataacagtgaatggaaactcaggaggtgccgtgagtcccatgagttactatcagaggccgttttccccctcggcatattctctcccagcctcactcaactccagcattgtcatgcagcacggcacatccctcgattccacagacacatatccccagcatgcgcagtctctggatggcaccaccagcagctctatccccctgtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctcccccacatgttccacctccagtcccagccgcttcgaccaagagatcggtcttcaacagaaaagcatgactgggatcctccagacagaaaagtggacacaagaaaatttcggtctgagccaaggagtatttttgaatatgaacctggcaagtcatcaattcttcagcatgaaagaccagcctccttgtatcagtcctctatagacagaagcctggaaagacccatgagttctgcaagcatggccagtgacttcaggaagcggaggaagagcgagcctgcagtgggtccaccacggggcttgggagatcaaagtgcgagcaggactagcccaggccgagtggacctcccaggatcaagcaccactcttacaaagtctttcactagctcttctccttcttccccatcaagagcaaaaggtggggatgatagcaaaatatgtccatccctttgcagttactcagggctcaacggcaacccctccagtgagttagattactgtagcacttacagacagcacttggatgtccctcgggactcaccaagagccattagtttcaagaacggctggcaaatggcccggcaaaacgcagaaatctggagcagcacggaagaaaccgtctctcccaaaatcaaatcccggagctgtgacgatctcctaaacgacgactgcgatagcttcccggacccgaaagtcaagtcggaaagcatgggctccctgttatgtgaggaggactccaaggagagctgccccatggcgtgggggtccccctacgtcccggaggttcgcagtaacggcagatcaaggatcagacacaggtcagcccgcaacgccccggggttcctgaagatgtacaagaaaatgcaccgcatcaaccgcaaggacctgatgaactccgaggtgatctgctccgtgaagtccaggattctgcagtacgagagcgagcagcagcacaaggacctgctgcgcgcctggagccagtgctccacggaggaggtgccccgggacatggtgcccacacgcatctccgaattcgaaaagctgatccagaagtccaaatccatgccaaatttaggggatgacatgctgtctcccgtaaccctagaaccaccgcaaaatggcctatgtcccaagaggcggttttccattgagtatttgctggaggaagaaaatcaaagcggcccccccgctcggggccggcgaggctgccagtctaacgccctggtgcccattcacattgaagtcaccagcgatgagcagccccgagcacacgtggagttttccgacagcgaccaggacggggttgtgtccgaccacagtgactacattcacctagaggggtcatccttctgcagtgaaagtgactttgatcacttttccttcacatcctccgaaagcttttacggatccagccaccaccaccaccatcaccaccaccaccaccaccgccacctcatcagctcctgcaaaggcaggtgcccggcctcctacactcgatttaccacaatgttaaaacacgaaagagccagacacgaaaacaccgaggagcccagaaggcaagaaatggaccctggcctttctaaacttgcttttctagtcagtcctgtgcctttccggaggaaaaaaaattcggctcctaagaaacagactgaaaaggcaaaatgtaaagcatctgtgtttgaggctctggactctgcccttaaagacatctgtgaccaaattaaagctgaaaagaaaagggggagcttgccggacaacagcatcctgcaccgcctcatcagtgagctgctgccagatgttcccgagaggaactcatccctgagagcgctgaggaggagccccctgcaccagcctctccacccactgcctcccgatggtgctattcattgtccaccctaccagaatgactgcggaagaatgccccgcagttgcctctttccaaggacgtgggacacaggccaacaggcagtttgccaccaccaagaccgtgggcggtggcattccaaggaccgtgagtcccctagaagttacttcatccactttgacttgacatgggggagaagtgcaccaaggggaaagaaggagggaacttccagaaaaagagaaattgcctgcaaaagctgtttatgattttaagggttcagacatctaagggagttgttccttttaaggaaagggagatactgtcttacatccttcagggaaatttgattccaaatttggtatgaggggaggaccaccacgggagagtgggcatcttcccgatctcatacgtagagcaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactgggtatggaagggtaaaatcccaggaaccaacagacaaggcatcttccctgtttcctatgtggaggtcgtcaagaagaacacgaaaaggtgctgaggactaccctgaccctccaataccccacagctatttctagtgataggattcacagcttgagctcaaattaagccacagcgtccctgtgtttactcattgaaatatttcaaagtgggggggaaccgtttcaggctctgtataactatactcccagggaatgaaggatgagctgggagctcaggagaaagtgatgtcatttgatgtcatgggaaaagtgtggatgacggctggtttgtgggggaccctcaaggaaggaaccaaatttcttttgggtactttccccgggaaaactacgttcaaagaggctgtgaaattgcgctccctccttctgtagaaggcccgcctgcccagcccatgcaccttgcgtcaacgcgccttgaaacacccccgcgggcctcccgttgtcatgccttacggtttccaatgcgccgtcaccatctccacttggccaccaaaccaccagcagagtagccgccgctgctgtgagcctggggacgacatggcaggctggtcccccggccgtgaaagtgtggattcctacttcctgctctaaggtttgacaccgtcaaaatgtgggatcagaaaggaaaaaaatcatgatactttaaaaatggtcaaatatttgaggcaaaaaaaaaaaaaaaaa

SEQ ID NO: 3523 - DNA, 898 bp, Homo sapiens
tggcgagggacagacgtaggccaagagaggggaaccagaagaggaaccagaggggagagacagagcagcaagcagtggattgctccttgacgacgccagcatgagctccttctccaccaccaccgtgaggcttcctccttttactggcattgcagcttcataggtcaggaccagagcttaatccattggtcaaatgccgtgtccaacgcagacctgatgggatttcaagaatttgctggaccattttggaagaaaagatgcctttagaagatgaggtcgtgcccccacaagtgcttcagtgagccgaattgaagaagcgggggctgcttctcagccccttcctttgaggtgcctccctggaccggggaagtcaagcccagccccagagagatggaggtgccctcggggcagggcccctgggactcctttttgatgattctgccctcttaaaaagcaagctgagggcgctgctcactgccccttcggaaccctgcggagatccagctgcttcgggggccaggatggacaggatttgaagcccagaagcggactgggctgtaccagctttccggtactgaaagataacaggccaggaggacaagcagggctgggcctagggacagaactgcaagagggctcctgtcccctggggggtctctggctggcattacggtgtcaatcttggttggccatgagagtatgttatcataccatactaagctgcagcttcctgtcaaaacttctcacattcttatgctaactgtagataaagtggtttgatggtgacttcctcgcctctcccaccccatgcattaaattttaaggtagaacctcacctgttactgaaagtggtttgaaagtgaataaactttcaagcaccatggacagaagacaaaaa

SEQ ID NO: 3524 - DNA, 14393 bp, Homo sapiens
gatgaggacggggacttggttgccttttcaagtgacgagaaattgacaatggccatgtcctacgtgaaggatgacatcttccgaatctacattaaaggtaaggggctgctctgggggctgcctgaagccagctcagcttgtactcagttccctgctgagtaaaaaacagggctcgatgttccaccaatgaaggggtcagcaatttgagggctgtttaagacagagacataggccaggtgtggctcacgcctgtaattcccagcactttgggaggccgaggcgggcaggtcacctgaggtcaggagtttaagaacagcctggccaacatggtgaaaccttgtcgctactaaaaatacaaaaaattagctgggcatggtgatgcacacctgtagtcctaactactcaggaggctgaggcaggagaatcgcttgaacctgggaggcggaggttgcagtgagcagagtcaagatcgtgccactgcactccagtctgggtaacacaaaaagactccgtctcaaaaagaaaaaaaaaaagaaaagaaaagaaaaaagaagaaaccctgagagattattttatctgtttctctcatttcaatcacgtaagctgcctaagataggaaaatgtaaatgattttagactttcctggaagcgtcttgttatctgcaaccactgtccaggggccaaaattattcactgtcatgaaattagtctcacccaaaattctcagactattataagaaaacattatctgtaaaatgattttgtgttatttttctagttgtgtttataagttacaaattagttttttggtgttttttgttttttatttttgagacaggttctcactttgtcactcaggttggagtgcagtggcgcgatcatagctcactgcagcctcatgcaactcctgggttcaagtgatcctctcacctcaacctcccaagtagctgggaccacaggtgtgtaccaccacacccagctaatttttaaagttttttagagatagggtctccctatgttgcccaggctcaaaaaattatttattaaaaacaaatgtaataattattttcatatttctcctttgctatactaaatacaggctatggcacacaaaaattgctttttttgagtttaaaatatttccagttgctgaactgctagtggattactatacattttatcttttgaggataaaataaaatatattacctaaaataaatcacctaaaataaattacctaaaagaaaatatattattttattttacctaaataaaataataaaataaaataaaatatattagtacctaaaataaaatatattacccagcgagcacaacatggaaataatttacccacaagaattatatttaacatatttacaaaacgctattgtgagacttttaatttcaccatgctgcaagtttattaaaagtgtcacaattcacttaatagcagtttcttaaactgaacaagaaaacaagctaattcaaaatgacttgaagagtgaagaaaaaaattctcaagatgcttctgagagttctgggtgatcagtagcagctcgtttgaagagccagaaaaagtctaagttctactttcaggagctggaggcaggaggaataattcaggaataattcaaggtggaggagaataaggaaaaacgcttaggagactgacacttctccatattattgttggatgagatgggctaggaagactcgggggcagtaatgtggccgtgtccacacatttctcctagacaagagggataagaacaaggccggcttctcaagaagagcccctgtcttagtcttttcctgctgctttatcaaaacatcttgtaaacactagacacctatttcttacagttctggaggctgggaagtccaaggctgggaagttcgagatctgcaggtgcagactcagtgtctgatgagggcattttcttgcggtgttctcatttggtgggaaaggcagaagggacaaatgctgtgtcctcacctgacagaacagatgttttatgggctgaatgtgtctccccaaaattcatatgttgaaactttatcaccaatgtgatagtattaagaggtagagccttaagaagtgcttaagtcatgagggcagaaccgtcatgggtgggatttgggcccttgagggagtgcgttcatccctttccatccctcccaccgccacgtgaaagatacagtatatttcccccttggatgcagcaacaaggtgccattttggaagcagagagcagcccacaccaggcaccaaatatgtggatgccttattcttggacttcccagcctccagaactgtgagcaatacatttctgtttttaataaattgcccaatcacaggtatttatagcagcacaaatggactatgacagaaattgatactgagaatgggatgttgctataactaatacctaaatatgtggaaacagctttgaaactgagtaatgggtagaggctggaagaatttggagatgcatgctggaaaaagcctgtatagacataaacagagctttaagggaaattaagggtgagggctcagaagacaaggagagctgtagggagagcctaaatcatcttagagattaattaagtggtctggtcttgatcagaatgcggttagaagtatagatggtaaagacacttttgatgagatcttaaaaggaaactggaggaaaggtcatccttgttacacagtggcaatgaacttggctgaattgtgtctatgtcctagtgttttctgaatggcagaacttaaaggcaataaactaggatatttgatggaagaaatctctgagcaaagcgttgagagtgcagcatggcttctcttgactgcttgtagtaaaatgtgagcagagagaatgaattaaaaacgaagtttataatcaagagggaagcagagcttaaagttttggaaaattctcagcctggccatttaaagaatgaaaaggcatgtttgggagggaacaccaagagtgctgccaggttcacatttgataatgagatgagtatgtgtagaaggaagccagatgctatttatcaagacaatggaagaatgaacccaaaggcatttctgaggttactggttctggattctcatccctgtcccagagtgccaggaccctgagggcagaatagttttaagggaggactcaggacaccatggaaccttggggcttgctgcctagggctgcctcaagtctctgcccccccaccccccacattctggtgcagcactctttggccaccatcccacgtgtggcttatgcaggcccttgtcaggccacccttcctgtaagccttggcagagtccacgtgatgctaactctgcaggtgcacagagtgcatgaactgtggagacacagccacctccacctagattttgaaggatgtgttggggaccctgggggcccagtctgagaattgtcactgaggtgaggctgctgcagaaaaccctcactagggcaatgtttagtggagcagtgggattggggccactgcagagagccccaaatagagtaatatctagtggagctgtgggaacagggctgtccctgagaacccagaactgtccagccaccagcatgcaagtctatcctgggagagcctagacctcaacctgtgagagctgctgcatgggttgcacctggcaaatccatgggagtggatcccctggacactaggggacccagtctccacccccctgtgctcggaatgggggacacagcatcaaagaagattattctgaagccccaagatttaatgctgtttgccttgttgggtttggacttacttgggaccagatactcctttcttcttgcctgcttctccctttgggaatgggaatgtacgtcctatgcctgtctcatcactgtattttgaaggcctgtaacctatttgatttcacgggctcatagctggaggggaatttcacttaggatgaattgtactttgaatcttatgcctttctaatttagaagatatttaggtgagactttggacttacattttaaagttgatactggaactttggaggccactgggatacaatgcatgcattttgcatgtgagaggggtatgaatttggagggcaggggcagaatgctatgctttgaatgtctgtgttccctgcaaaattcatgctgaaacaatcctcaatgcaatactaacaggtggtgcctttaggaggtgactggattatgagggcaccttcctcatgaatgggattggccccttatacgagagacttcacatgagatttggccccttttgcccttccactttccaccattgaggacgcagcagcaagctgtcatcttggaaacagagagcaggtgtttggaactggttctgtttcatctgattctgggggcccctctttttccctgtgcaagatccccaaatttgcttccttctctcaaagaaagctcccaatatagatgggactcaaagggagtcatttgccctctaagaggtgtcacaatatgtcgtctcagtcattcacaccttagtaagaaaaagcttttcaggtccttgccagagattcggggaaaggctttgaactgagaaagaagccgcgcccctgaggagggcgctgcccggaagccacgctcacttctgcttgcacttaggcgacctcgggagctcggactcctacgcagtcaccgggaagggccgccgccccgcccgcggctgctggcccgggtgacgcttccgcctgctataagagcagcggccctcggtgcctccttcctgacctcgcacccagctcggagcccggagcgtgcctcggcggcctgtcgggtaaggccgggcctcggagcggtggcgcgggggcgggcgcggggagaggccaggctccctcgctcagcttccagcccggcaccccccaccccccaggctcaggcccctcagacccgcagctccctgcgctcgccctccccgccagcttcgcgcccccatcccttccgggcgccccgacggagacagacgacctctgatcccccgcccccgcctgggtacaggccgggccagcccgcgagggagggagggagggaggacgacagatgcaggcggaaggcaagactgaaacctgagatcagaatgttgtcccttctccctgaattcccttcctcccagagctgtttgtgacggtttccaggcagcccaggccaggccgcggctcctatctgcagctgcagggagagagaggaggaaccccgtgcgattctagagacgatttcacaaacaaggagaaatcagcttttgtgcttacatgccgagcagccagcacggttcttctttgcctgtcctcgggggaaatcagggctctgagagtggagatcgagatgggctagtgggtggcggatgggacgctgcacggccagaccctggactgtggtgggtttccaaactggcacatcctacaccggctctgagactgtgggcactggacctcataccttttgaacctcaaaaataaggaagaattatattattataataattacagtgatacctttgctggagttttaatgcatagtaggtagctgagtctctgatagaaggctcttagttcaggtgaaggtaggcaatggattcattgcccaatgaatcagagacttgaatcaaaggctcagaagcacgtgcgctcccacacataggttgggaagacccagggctgggtgggccctcccaccccactaaagctggggtagctggggcctgccttacccccgccccacccccagactcacctgtctgcaaggtcagagccctttagggcaccctgggtgccctaaaatcccctataactgctgagtccttggccagaatggtcccacatttgtgggcctgggaaagtgttcttgccctgctggaataaaaaagcggggagaaagtacaagatccaggatgcctcagggcggttggcagaaattgaggaagcttctggagaaatagtgctgcctaatctgctggcgtgggcagtgggcaccatgaggaccctgttctgtgttgcagttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaaggtcagcagaaacaaaaaaaagggtctgctttcctcccatctccctacgaatggacagtctgcatggaaaggttgtgcctttgagctcttaccttgtgttttcagaactgtatttttatgagatcagactttcagaaaagtcacacttgtatgcaggcttccattcatcatcaggtttttcctaagtacctaccacgtaccaggaactgtttttcgtattgctgaggagacagcagtgagcaaagctgacaaaaatccctgcagggcgaggcttctgttccagtggatgaatctgacagctttcctgaaaggcatactacatcctcctgagctagcatcttccagtttttgctttgcatatgatgatatgcaactcataaatattgcctgttatataacactactttcaagcataatgagaggaataagacatagggaatgcattatagtggagatagtggcattgcttttttgcaaggaaaagagaaaaagtgaccctgtggttctgtagtcccagggtgctgcgcatggctcagtgggctgtggcatagcacgccctgcaggggaggtgagggggagacccggcagcttcaaggagcgggaccccagcccttggcgatgtgacaggtcactctcatgcccagccttccttcttgtccataatggacatggagaggacttctgtgcttggtactctttaattctgagaagagaactctagctctctctctctaagctcagcagaaaggagtggtaaaagtggaggctcttctaacatacctgccgcaaattacactgcacctgttccttggcaaggtgcagcctgggattcaagttcaaggggctgcgaaacttctattactcatcgctttagatatgaaagcattttaaatgtttttttttaaatccattaaaaaaaaaaaacctctgttactaattgttagttgcttcttgcagggttatatcagttcctagcttgaggttttccacgggactttaaaacctcagcaaagaataagttttaaggactcctcccccatttccattaaagcagatggagcataggcacagtgcaaacattccatatctcggtgagtaatgtggacttcgtaccctatgcaattttgttctttgtgtcttaatcataaaggaaccagcctaggtctcataaaaccacaaagggcctcttgatttgtaactgatacatggggaattaaacttttgccagaatgttaagtttaaggaagttattttaaaataagtgagttactgatgttaatagggtaataaaattttaaaagcttcagtctgtactatctttgtggttctgaatagaggatgaatcctatttttactgcttatttctgagaactttcagtaaaattatatttgatacagaatatatatatgaacataccatttattattttctttggaaaaggcagacttatatataaatatttagtatcttaaccacccacatttgtggaactgcaagtgtaacaaagagtgatgtaaaagcaatgtgtaaagttgtaaacattctgtctcacgaagccataaattttggatttcctattgtttgttctgcaatgacaaattaataaagtattgggtttgggatcatcaataattagtaataaaaacacattaatttaatgtgatagaaggaaacaccaaggaatcactttatagtttcaaaataaatggttgtagaaagaagattttctttattttagactttccatttcaacacggttgaagaggttcattcaagattccagagtctgaatgctgatatcaacaaacgtggagcgtcttatattctgaaacttgctaatagattatatggagagaaaacttacaatttccttcctgtaagtactttgcccttcacattctaaaaccccactagacagtgcagatattttccagcacaatcaagtcatggaggtcagttttaatatttgtaaactttcagaaaaacaatacagaaggcaaacatggcaaaaacaatatggaaggcaaacacgacagaatgcaaactttaattgacatggtgattttgtgttacagtctttttagtgaaaagatagctcttggaggttttactgaagcaagagtacaatcagtgtttgtgaaatcttagtcaaagttcagaaaagagtggtaatttctatataacaacaacagtataagggttaggcttaccactactggaatgcacagttaaaagtggctaagatcgtaaatttaatgttaaatgatttttactactataagaaaaactataagagttagaaattttgtgttacatggaattgtagccttttaggacaatttctgttgctttttgggattttagaaaacaatttctatatgtagtaggagttatatatatatttccttttccttttttttaataggagttcttggtttcgactcagaaaacatatggtgctgacctggccagtgtggattttcagcatgcctctgaagatgcaaggaagaccataaaccagtgggtcaaaggacagacagaaggtgagagcctgggcagaatggaatcattatgcgctggtcatgtcattcgtttcctcagtccgccttccctacctgcagttattccctccccagctcccacagtcctggcgcacatcgtggttacagtcagaggacgctgccggtgcgtgaagtctgcactgcacgttgctggacagctctcacatgttcgaagttcaccagagtggaaacttaaacatgatttaactcaagcagctaaatccttttttctcatcagctccccaaaacttttaaagttgcatttcaaagttaaaaccaacattggcaggcgcggtggctcatgcctgtaatcccagcactttgggagcccaaggcgggcggatcatttgaggtcaggagttcaagaccagcttggccaacatgatgaaaccctgtctctactaaaaatacaaaaaatttagccaggtgtggtagcacacacctgtaatcccagctactctggaggctgaggcaggagaatctctcgaacacaggaggtaaaggttacagtgagccgagatcatgccactgtactccagcctaggcaacagagcgagactccgtcgtaaaaaaaataataaaaataataaaaaataaaaaataaagttaaaaccaacactgaatacagcaaaaaaggaattaaaattttgaggagaattcagcctgccaaaaattacctaatactcatatggaaagaaatgtcctggaatttcatggaaatacctgaaatcaatattcacaaactactgtggttgtaaatttttgccaacatcttgtccagtaaaaaagttgtggtaggcggggactgacttgcttttagggtgcaatttatttctttgctacatctctcttcttacatagccctgtattagtcaacccactccagaagacctgtcttccattatgggaattgttcccagccatacttatggtcacgaaggtgacctttatttccatggagtatgttctgctggtttttttgtttgtttgtttgttttttgtttttaagagacagagttcttgctctgtcgcccaggcttgagtgcagtggtgcgatcgtggctcactgcagccttgacctcctgggctcaaggaatcttctcatctccacctcccaaagcactgggactgcaggtgtgcgccaccatgcttggtcttgttctgccttttggatattgtttaaacctttttttgtgagagtaggcatctactcagcgatttgaagaagtgatttactgatgactaaagatatcttcattaagaatttttttttttctaaaaaagaatggttgttacaaaataaggctcattgtttatcatacagtccagaaaaggagaattttcctgtcttttgtctttcggcacatttgacttgtttaaaatgtcaggtccttgtgggaagtttgtgtgtcatcctggtctgtctgccccacaggttgttatacttaaagtagagacatgttagtgagtagggctttcctaagttaatatcttgttaaatgaaaattaagtagaaattatatatttgaattgcatttccgtgctaatatattgtcagttcaaatttggaattccgatttggattttttttacgctaacttgatttttttttaggaaaaattccggaactgttggcttcgggcatggttgataacatgaccaaacttgtgctagtaaatgccatctatttcaagggaaactggaaggataaattcatgaaagaagccacgacgaatgcaccattcagattgaataaggtgaggtgaggtaactgtacagagtcatgcattgctctaaaagaatgcagagaataatttcagtgattttttaaaactgttcagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaaggtatggctcctgggcttcatgctttgtggttcctcttgcatgtgtgtgtcgcatggtaggtaggtgcttgttaagtgttcactgatggtgcattttccagtagtttgtcattcctttgtaaatgtagcccatcaacacttactacactaaagcccagagttaatttttttttaaatttacttatagagacaaggtctcactatgttgtttaggctggtcttgacctcctggcttccagcaatcctcctgcctcagccttctgagtagctgggactatagctgtgagccactgtgcccggctaacgtttcatttttcaagaaagatggccagctactttcagtggacacttgtgatggggtcattaaagatctatactaaatataatactggttagtggcagctcatggaaaggctcttgaattagctttagaggaaattacagtaagatgaggattgttttactgaggaaaaagattgaaaagccccaaatagtgtagcatatatcttcatcacgtactataaaattctattattacactgtttgttctcatcacaattcatatagatagtgaattaaattttcaatgggtacaagacagaaaaagcctcatgtgacatgttaggcctatttactagtatgatctttgcatgaggtttccattatatgtagggactctagcctgctctgtgctctccgtctcctccctatccacctattcatcatccttgctatcaggaagggggtctaatgttaatcatttgcatgtacagacttttaatacattgtataacaatcaatgtggcctttcttttggttgtatttttgcattagttttttttctgattgtaaagtgaaaatctctagcctcttaaaaggaattatcagcaccattagaagaagtagagtgatggttctattccagtccaatagctataacaatagtaatgataatagctgacatttatgtagcactatgggccaagcactttatatacatcatttcatttaatgctctcaacaatctataaggtagatataagtaatgtccacatcacatttcagatgaggaactagctccagtgcataatctgcctttaaaatttttacctaggagctaaagttattagatattacttcagcttcagtgggattcagactaaatagaagaaatattttaaatttcttctagcactacttcaacccggaagtaatagcagctgttcatggacctattcactgtgaatccattgtgggtagggggttttagtaaaccctggatgaatggatggatggatgaatgggtagatggatgggtggatgggtggatgagtaaatgggtggatggatgatagataggtggatagattgttggatgggtgggtgggtggataggtgaatggatggatggatgggtggatgggtagatggatgatgaataggtggatagatggttggatgggtgggtgggtagataggtgaataaatggatggatggatgggtggctgtgttgctgggtagctgggtggatggatggatggatggatggatggatggatggatggatgagtggacaaatgggtggatggatgggtggatgggtgggtgagtggatgatggacccaatgtacaaatcccttgaacctttgatgacttggaacaccacctctgccctatttcaccaattgccataatgaaataaaatgctccaaatggaatctgttttggcacaaaacatgaaggaaactaactagcaactgatattatgggtccattgattcaataatactttattgccttacttatgtaaaattgatatcacttcctctttcgcctcatttttaattgcagattgaggaacagttgactttggaaaagttgcatgagtggactaaacctgagaatctcgattttcaatgaagttattgtcaagctttgcccaggttcaaaactggaagagagttacactctcaaactccgacctcgccccgcctagggtgtgccaggatctctttaaaccagtaggcaaggctgatcctgtcttggcatgtcaggagccagagactatttttatatcaaaaattgtccacaagtcatttgtggaagtgaatgaagaggggaacagaggcggcagctgccacagcaggcattggcacctttagacatgttgatgacgaaaggaaatttcactaccgaccatccattccttttccttaattcggcataatatcctcaggtagacatcctattcttgggggagattttcttccccttaggaaggaaaggggactgtaggcaatacaaaaatcaagcttagtgctttattacctgagtttttaatagtagccaatatgctcttatatctttaccaatataaccactggtccagacacaagtctttcattttctttgtaagtttggctctgttggctgtttacacccatggattttggcatgggtatctatttttctcttctacacttgttaattatccactggtgcttttgaatgcatcaagtaaagaagaagaaaaagaataccatcccgatgccgtagattccttgacccatgtagtaatcctataaaattgcctatatccctccctgatagcccattggggaaaaccatgataagatggtcatttattttgcagttagaattttggaagcccacaaaatagacagacaccctgactgttgaagggaggtttaaaaacagatattcaattgaaatgtaagagagcaccccaaattgagagcccaggttacggaagacaagcttgcctcgcctgacttttctgtcccttgttctgcaggattagtattctgttacagacctctagtttttagactcttcaattaaagggccaatgggttataacctgcattcccttttttgttcttctttatgtataatatatagttcatgtggcgctgcatgaaatcaagaagtgggtgtcttaggataaaagataccaagagtctacaaaaataaccatgtagtaagataaactgctgaacaaaggttttactgttagccaccttctcatgtgttttcttttctctttttctttttctttctttctttcttttttttttttttgagacagagtcttgctctgttacccaggctggagtgcagtggcacgatctcagctcaccgcaacctctgcctcctgggttcaagtgattctcttgcttcagcctcctgagtagctgggattataggcatgcaccactaggcctggctaatttttgtatttttagtagagatggggtttttccatgttggccaggctggtcccgaactcctgacctcaggtgatccgcgcacctcagcctcccaaagtgttgggaatacagggcatgagctaccatgcctggccttctcatgtgttttctgattaaggctcttgacttccaaggctgtgtggggaaatggggtgggggctcttggactgatataaaactttgtcaaatgtagttctttgaatggagcttgaaacgccgcatattcttgctcccccaaggatagtgggcatcatgaattaataaaacgtcctaggattctgcaagctaaaaaaaaaaaaaaaaaaaaaaaaaaaaaaa

SEQ ID NO: 3525 - DNA, 1508 bp, Homo sapiens
gcggccgcttggcgccccggtgcgcctggaccccactcgcctccatcttgctggtgctgcttgggccgctcttttagccctcgcgccccccgccgttggctgcgggagagcccgcgtcccactcccgtgctcgcctcgaccccgcgccgggcacctgtggcttgggacaggatagaagggatggttggggatacttcccaaaactttttccaagtcaacttggtgtagccggttccccggcccacgactctggggcacttcccctgaagctcctctccggagcttgacttcttggacctcctcacccggcccaaattccaagcttccagaaactcccaacgtcggtctgccgtccagaaagctagcttgcagtgttcagggacgtccggggaagaaagcaagcatgtgggggggacaagaacagttagtcctgggaactcgaaagggaaggtgcttgaccagtgggggccttagcaatttgaagggttgggaaggaggaattatatttgcaaaggggctgtctattagcatatttcctttgaggggggcaaaaaaaaaagtgccagtatcgacttttacaagatttgtggccaagtgaggatattataatcctatgtaaacagaaaagtccccactttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagtcacatttcttaggattaagggtccaaaaatgctgatctaaggggttgccatggtgttgaacaatgcaactttttatttaaaaaagctctgcactgccatgtatgaaagtctctttatgatgtttggtttttttggtcatttttgttctttacatccaaggaaattttatggtttaaatatggcggagaatgtatattgcctctgctcctatcagggttgctaaaccctgggtacatccgtatataaaatgtataaaaactgggggtttgttacccagttgctgtactttgtatataggaatttttattaaattgtatgccttccagaaataattttatttttaaaaaaggaaattaaaaagttttaaaactcacatcccatattacacctttcccccctgaaatgtatagaatccatttgtcatcaggaatcaaaacccacagtccattgtgaagtgtgctatatttagaacagtcttaaaatgtacagtggtattttatagaaatggaagttaacattcttattttcaagagaatttatggacgttgtagaaatgtacaaatgcatttcccaaactgccttaaacgttgtatttttatagacatgttttttaaaaatcctaagtttttaaataactatggatttgtgtattttttttggttatttgttttattaaaacatgtacatcagtaaagagttctaaacaatgaa

SEQ ID NO: 3526 - DNA, 826 bp, Homo sapiens
tgaccagcgggtgcagccagcagtaccggcggctcccggtgccgaggctcacccagcaagatgtcgaactccagaaacatgatgcccgcctgcgaccgcgcccacgccggctacctgacggtggctgccatcttccggggccgcatgtccatgaaggaggtggacgagcagatgctcaacgtgcagaacaagaacagcagctacttcgtgggagtggatccccaaacaagtgtaagacgtcctgttgcgacaattcccgccccgcggccctgaagatgtcggccaccttcatcggcaaccagccacgtccatccaggagactggttcaagcgcattctccgggcagttcaacggccatgtatcccgccgcacaggcaattcatgacactgctaacacgcgcgaatagcatggcacgagatggcacttcaccgaggccgagaagcaacatgaacgaccctggtgtcccgagtaccagcagtacccaggaacgccacggccgacgaacaaggggagtttcgaggaggaggaggggcgaggacgaggcttaaaaacttctcagatcaatcgtgcatccttagtgaacttctgttgtcctcaagcaatggtctttctacttgtaaactactggtgctcagtcttgaatctgttagaaattcacaatgttgatgtactgatgtggaactcctctacaaaattacagtattgtctggtggaagggtatctatactaaataaaaaaagcatgttgtagaaaaaaaaaaaaaaaaaagaaaaaaaaaaaaaaaagaaaaaaaaaaaaaaaaaaaaaaaaaaaaaaaaaaaaaaa

SEQ ID NO: 3527 - DNA, 3424 bp, Homo sapiens
ttttttttttttttttttttttttttttttttttttcagcattattaacaaatttattgaacaactagaacttgacaagcacatgccaggtagaggggatacagtggagagcaataataatgatgataatgaggagtagtttttccctagcaggcagcagttgaaaggaatattggtttaacatccaccaatgagcaggggtggatagacccctctcctggagacagagtccataacgggattaaaaatatccctgtaagccggtcacccggtggctcaagcctgtaatcccagcactttgggagaccgaggtgggtggatcatgaggtcaagagatcgagaccatcctggccaacatagtgaaccctcatctgtactaaaagtacaaaaatttgttgggtgtggtggcgtgcacctatattcccagtactccgggaggctgaggcaggagaattgtttgaacccaggaggtggaggttgcagggagctgagatcgcaccactgcactccagcctagcaacagagtaagactccatcttaaaaaaaaaaaaaaatccctgtatttcttctagcttcctttatcccaaaatacccaaatattaacgaaaaacctctaggggtatttgctctgcctgggaaaccttgactgaaggaaggctgggctctgggctgcacgatcacttattcacatttgttggggtggggaacacatctgtgccccctttattaacctgagtgtgggcctctagtctcttttcaaagtcacatgcccctgtgggaactggcaacgttattctctcaacccaagacacttctgcagagcccaatccaaaggcgtgctgggtctaaggctctgacaattcagctgggaaggagtcaacaggggtgtcaactccacaaccacctacagtgatccttatccctggagccatcctgggaaaagaacctcagggctacatgtgggctcttcctgtgggaaaaaaaatcaggctggaaaagaacaggcaattagccaggggactgaagctgaacatctcccaactgcacaaattaccgtgtgagttatgtaagctacttaatgttgccctgcctctgcttccatacttgccaaatgagactacctgacagggtgttgtgaggattaaaggagtgacacccaccaaaggttcattaacacagcaactcagaacgttttaaattctccattaatgttagtcattgttgttcagatcccagctctgttgttcactattcctgtctgctttgtaaagtcaatacacttttctacaccccagtttccttatctgtataaaggggccaataaggtggcaccaaactcaaaacaactgtcatatggaataatggaatgaatatcagtaaagtgcttcagtgcgtgcctgtagctttatggttctgactggctgttgtggagggtgagacccttagctccaggctgggcagggagaagcagagatgttactttccagcctgaggctcccccactttcattagctaagccccggggtcaagtggtgtctccagggaatgatcaggcactaggtcaggatcgggggaactctctacttcttttggtattgggcaaatggtcagggcagtgggctccaaggtcaaaattctgaaaacaggatatagaggctcagagaaagaggcgtgcggaaaggtgtagatatgagatccatctgtggcattatagaacgagatctctccagtctcatagtccaggaagatccccactttcctaggaggctcaggaagtttcaggttggttctgggctcagtgagagcccgatacttattcccatcagtcaggcccatagtccagtatccgttctccggtgtcattttgacccaaccttttttcctctccacgttcttactacataccccaatatgccactcttttctgtcccccacttccacctcccagtaatgtctccctgatgtgaagttttcacagccaaggacacagtaacgccattcaaatctctcagggttgtctggcagatcccgcggctcttcagcacgctgcacactcctctggtcctcagaaacaaggaggatggcgtttgccgtgtctggatccagaatcacatccgcaggtttgaagagggccattttccattcatgataggccaaagacttctctccacgagccatgtactggattttcctccacttgagttcctcctggagcttctctcttaggcttatttcttgctctgttgcagcgtatcccatttctttcatctctcgctctctttctgtctccctggacagagcaattttttccttctgttgtctccacaagaagtaactggctcctgcgagaagcagcaacgagataggcagggttccctgccagggggcgggcgatccacctctgggcgctcctgaagaaggggtctgcgatggaaatgctgggctgtcttttccaggccgaggagggaacttctgatggtacaggatacaccctccccagagctgcctctcatgatcacagatgctgctactgcatacaggcccactccgtatgcaaccacaggtgctcccacagtcgggatgttctctcctttgttgtagctccactgtattggggttggggggtaccagccagtggaccttgcactccagatggatccctccatccttgtaacccttcacatcaacgtgaagatcagaacccagtgctgcaaccttcagctccaccagggctttttcgtagaagtcaccatcttggaaataacacaagtactttccactgtcagaggctgtgacgttgtgtaattcggagagcagccttcccctgcagtgaatgccatcccgccagaatcgaagttctccctcgaatacggtgccactctgccctgtccttcccacttccctttcccatctgccatacacgttcacccaccctgccttaggctggaactcacccacttcagctccatggtctctgcactcatggtcgggaacaggtgacagggcagatcagcgtcttcacccaccatggccaggatgggcccagagggtccaagcacagaaaactgagctgagtgaggcatgagcagctgaagcaaaaggaggcagacacgaaagttgagcagaaggaaggccaggaaacttgccattttcattcatgctgcatatcaggagatactggaaggtggggggcagacactatgacctggaagaagctttaggattcttgcatggaaatgtcccaccttccccagggctaactcaaatatggtgaccgaagaagatcttacctctgccaaaaatgtctgtccttgagtgtcttcacctttgagtcccaacattgaaaatcacctcttagcattcccctctgaaaatcacagcccacagaagaaaggcagttaatagttctcccttggtgccgaat

SEQ ID NO: 3528 - DNA, 1537 bp, Homo sapiens
  misc_feature (1)...(1537): n = A,T,C or G
gaaggattcaggggctcaaccccagcctgagtgcctgggctgggtggatccacagcggggcgaagggtcccacacacagcatcgatgggggctcagggtgctcagccctgggcattacataaaagctgtttattgacattacgttcttcagagtaacaaacccccttggaggactctcctgccgggatgtccatgtccgcctttgctccgagctggggtctcatgtctgtggtgctggaatccagagccctgacggtaggggagtgattttgcaacacagttgcatgttcacatcttcttgacaggattccttgatgggagggctggaccctcggcacctgtgccaggctcccaggaagggtggccaggcccctcactgccccatgcaagaagtacttggtgttgggagatcttcttccagagcagagtcttgaggtggcttaagcaccagcaagttaatagggccttccacctgggctggccagcccgctcagcgtgggtacaggtgcgcacttgttgttgcccagctcctcgccgaagtcggcgggcgcgccaggccagcagttagccccgttagcagtgcgcacaccttggcccaggttgggcttggatgaggttcgcccttgcactgcctcatggagcctgtcaacacggggccctgcagtcagcngcccgtaggtgcaagtcggtgcttgtgcttcgcagcggcggccctgcaggaagcggcgccacggtggcctcggggtgccacctgctgcaggtcggccatcttgaagtcgtaggtggctgtgtagcccacgttggcccagtgtggtctcacacatgtagaaagtcccgtaagagccgtggaagagctcctccacgaactccagcaggccgatggcgatcttggcccgccaaggccacgcgaggcgccagccactgctggagacgcaccctgcagggcaggcggcagcagtgggcgcaaccaggggtggaagggcggccgcgtgccaggcgaccatggcaacgcctccggatgtaggtataggtccccacagtagcccagcagtctggaggcgtgctccttctcctgcagggacagcagcaagcaggaactcgttacgctgcagcagggcccacacggacttggcttccgcccaggggacacccggttgtccttgttgaagtcagccatgagcaggacctggccaaccagcgccggcagtgaagtgcaggtctccctaggttcgcctttgaggaagcctgagggtcatctcccggaattccattgagtggaggtgccccagggtgggcanttgtaaaacaagttaccaagctcccgccggggggggccgcaatccgaccgggccttggagtcgagggtctcctcaatgccacacttgatggttacatccttgtcccgccagaagcccgctgtacacctgctggcccggggccaccgagagggcaggtcctccactccaccatatgcagctcacacaggtcctggcagacggagccccgagatgatccccttgcggtactggtcacaaat

SEQ ID NO: 3529 - DNA, 8206 bp, Homo sapiens
  misc_feature (1)...(8206): n = A,T,C or G
tttttttttttttttttttgtaggtagaatcatttttattggagcatgacctgtttggggcttataactctgcagccccctatgggtagctgggggtgggggaagatagtatcaaaaaaacggtgaagagagctgatgaggctgtggggactggctggaagctgcttggcaggggtggagttgggctggggcccccggccagattcaagatcgaggtacagcagcgttaataatactcttggagcgttaatactctggggaggggcaggcacttggggggccctagggcatggaaggcacttggaggttggggaggggacaggggatgtactgcgggaactgggcggggcccaggcccctggggtattgggcaggcacttgtggggagtgctgggggtttngggcaagtttgggccccgacaagccccagaaaggcttttggtagtggcacgcacagtctctggggccgggtctgcattaaatagaagaggcttcttttagtgctcatctctgaagctctgaaggcaagaaacttgtactgctgcctgccggatctgggcccagtttcttccgcgcctcttccaagctctcgttcctttccgaagcatttcttcctgtgcttgcgatgatctgggcaatgccgccaaccatcttctctttcaccaccactgtctcattctcctgctcttcaaaggctcgaggcctctggtgctgctttcaccagattatctgaggctcgcttcacttgcgttgccagcagccctgaagtcgtttcattgcctccgagtcctggtcagccttgaccttgcaggcccacaaggagctgggctgtggaggcagctacctgcttggctgaatgaaaatgaagcttctccctggctggcatggcccttgtccagctgcattggctgcctcaacacaagattgttggtggccgcagccaccatccgggcagcagaaatgaggccctgggaccactgcccatcgtccagtgcattggctggaatggcacccaccttcccttgggccactagttctctctgggcagccgacgcagcctttaccagtgcaactggtggctgctgcaatggacttggcagcttctagtatctgctcctcaaagttcaaggactcatctgcctccttgggtttggcccggggcttcagctgctctagctttttggctgcagcctcaatggcggctgcagctcccaggagctcattctcagcaatgacctgtggggtcctctggttctaccccattctgttcccttcatggcttcagcagcctggatgagctcagtgacggaaccagccacacgctttgaatgtcctgtcaactgctgcttgagttctgggcttggcttctgcagggtcagcagtacatggtccagcagttccaggtagccattggcacactcccggccatagtgcagggctcgaagccgcacatcaggggccacttctgggtggtaagctgcttccttgcaagcccgaagcatatctgcaatagcacggcggctcagattggctgtggcaatgacatcttcctggcgacaggaattgccagcagcaacggccttggcggttgccatggtgatacccttggtcattcggatgaagtcttctggggtagaggtcttggcaggtggctctggggaacagaaaaccgccagctcctgccgtatgtgttctgtggttgcctccagggcccgagtgcctttggtggcctcatcttccacggcttttactgtcttaagcaatgatgtcacattggtcaccatcaccttggcagagttctttagctgccacacagcagggtcatctccaactttgccagctgcagccttcgttgcactgatgaggtctcccagggctttggctacatctttcactgcgttgattagtaccacctgggtctcagggtcctcagctcccaggctggctgcacccagcttgaccacatcagcgaggcgggtgatggtcgccacggaggactgggcagcctgcgccaacttctcctggctcccagctgcgttttgcaccaggaccttggtgtcctccaccagcaccttcgcagtcttcaggatgccctcccggtggtcagcgaaagtttcagtaccctcacgattgagcgtgccagcagtggcgaacatgatggtggtgtcgaggtcagcaatgataccagacacagcgctggctgctgtgatgcaggcctgggtgccacgattcccagcctggagcgcacgcaggacgtgggagaccttctcagagactctccgggcacactctatgagctccttcttggtgtaggcatcactggggctgcactgcagggcgcctgccttggtgaccagagcggcacagccatggcccagctcctgtacccggtgtttgatatgggaacctatctcttcattttcagcagccaccgctgcaggcttggcctccgaggccagacggccatagtcactggtcagctggttagcaagagggcccagctcctctgggctggtgtttgacttggtaaccatctcctgaacagtcactgcaatggccttggctgtccgcaccatagttgtttggtaatccacgaaggaaccttctggttcacccattggtccttcatctagctggttgatggcctgggtgatggagtccaccatgccacccacgaccccagcagcactggctgcctcgttgagggttgttgtcaggtcctctacggcctcggtcatcatctgcacagcctcctccagggcttcctgggtgtgagctgcttgctttgggttaccaccagcctccttggcagtgtatagcaactgcagggcagactctgccaatgttttagtctggtccaggagtgccatctgctgcgggtggctcagggtcttggaggcagcacccactgcagccagggtgagcggctcaaagtactgcgccatctgggacaccttgtgtcccagctgggaggcttcagcccgggcagcatgggccagcggctcaatgagatgggagatctcttggactgcagtcagcatctcagtgtgcaaggcctcttgagagattccctcacggggagcaagctgctggctgactgcagcgagggaagcctggtctaggtcccgtagacaactgttcagagctgcaatggccgtttcacactccagctgccctggagccttgtccctcatgcttgtaattagcttcttgatggagtctgagacagtacgggagtggccggccagcaccgaccagctcggggggtcccgggggttgactgcgagggcccgggctgtctggatgagtcccccggcactctctaacattgtctgggcagagatcacaatgggctccatggcagcccgaccctcagggctgatctgggcaggaatgctggagaactcagggttggacgcaaaggcactcagattgtccacagcctccagcagaggggctgttgctgctcggcactgggcacggttctcctctgtgaaaggcccatctagcgccttgatggtcttgacaagattagctgtgctgttggccacctccttggctgactgtacaaactggcgcttggcagtaggattggtggtacgggcagaagccaggcgacagctgttacacagtgcagaggtgtgtttagccacaatggtggctgcagagagcacctgggcctgggtacagccaggctctcccaaactctggcaggccatctgaattgcctggtttgcacgggcaaactgtgtgggctccactagcccttgctgtccagcttggctattggggtcagagacaccaaccagatatgcagcctgtgcagctgcctcggtgaagccacaaagtgcctttgaggctgtggaaatggcatctccaaactctggcaggtttccgttcttggcattttgggagatgccagtcatggcctcgcccagcacctttgagttctccattacactgtccaggcaaccaaagtaggacatgtcattgatgggctggactgggttctccaggagttcccggaccgtctccaattcccgcagggcgttatcacactccttctggccgggtgcctgctgggtgcacatagtgatgagctgattgatgctgtcagttactgccctggcagctgcagccagctgactcttgaggttaggggcagcagggtccgtggacagggccttggcagccagaagaagtttgcttgaggacatggagatgcccttcaagtttggacacaacttgggctcggtcctcctggctcggagcctggcctgccatctccacaccagcttccaggaaggtgctgaagtcctgtccaaatcggcctgaggctcgagccaggtcctgaggggttccccgagaggcctgcaccagttctgtggctgcctgattcagcccagcagcagcttcattcaaccggctctgagcttcttgaaatgtcccagtgctaggaggaagcaagtcactcaggagtcgcttgctggcatctccaactgccctcagggcattatccacatcgcgctggccaggtaggcagctgacacagcggttcagagcctgggtcactgctttagccacctgggcaagccgctgctggctctcagggtcccctggatggccagctgcctttttcgcctcctcaatgaggctgctggccttgtccagcacatcactggccgtatcaagtacaatggcctgcactgcaggatctgacgtcagtgcagcgactcccctagcggcctgggccagtgaccgcagcccacctgccacatcccgagctgcaatacctgcataattctcattgccctgggcaacctctcccagtagctgggcgatggctgagctcacggctttggtgctgttgcccaggtcctgggtacacttctccattgtctccccaggtaagggtttaagcttgccatctcgagctgctgccttcacttcctgtagatctttctctagattctgtaccacactcagtgcagaatccatctccaaaggtccacatgcttcctgagccttctgggcagccgtccggagttcagccagcgcggtgcccaggttcttggcacactgactcagctgcatggctgaagcctggtcctgaatcgttggcactgaggcctttgcagctgccaccatcttcccacctggctgcaggaagctctggctggcagcaatgagggcaagctgagcgctggggctgtcaggctgggcttggcttcctcggacgccctgcaccagcagtggaatctgctctgccactgccttgcagctctgcaccagcaggggctgggggccggcagaggctttgggggtagaggctgcgtgctgagctgcagcgatggtctgtgtggctgaggctgcagcctgcttggctgcatgctccaggcgctgcaccagctttttcttgatggcattctgcgcagctgcattggtggccatgcgcagcccctcagctgcctcccgcagccgctgctgctgctcctcactgtcagggtgggcagctgctcccttggcagcctctaccatcttggctgtggcatcagctaggatcttggcagcacttaagagcttgcgggagttctccagatcactttccccctcagcatcagccttgatggcattgaccaggtcagatgtggcttgggccaggatgcgggcctgtcccaccatctccccagcatcacccatggagctaaagatgttctcagtgacggttaggatggtgtcagtagcctggtcataacggccagcaggcccagcccctgtggcatgggctttcacatgctgcagcagctcatttagggcctgggtgacagctgtggctgctgctcctacccctcgcaacagttgcccatcctctgtagctgcctgggaggcagacacacagccctccacggctttggctaccagtcgtccagcctccaccagttgctcttggcagacaggtgagctgattgtaggtgccaccaccttagtacaggccactagttgggaagtggatagggcacactgtgttgctgcagcaataacttgggtctgaagtcccgagtcctctgtccgctgggccacactcttggccttgaggaccagggcagctgcagcacttgccacagctttggcgagctgcattagcgcatcctggaagtgggggtcagtatcactttccccaatttgttgcaacagctccccactggcctggcccacgttcccagctgcttgcagcaggttctgacggggctcagcactggctggttgggcactgcgcagcagttctgacactgctcccgcaaggccctttgctgcctgcaacaggggccgaccactgccgccttcgtcctccagcaaggcagccagcagcttcaccccacgggacatctccgtcaggttggaggagattgtggtgactgcacagcccactgcggtatagtctgtctcagcagggtcccctgctgtcaggttcaccacagacgcagtaccagctgtgatggcatctacctgagagtggatctcatgctttgattcatccatcttgtttttacgccaggccttagaggcagcatcctggccaagaggcggcagagtgtcaaagtcatccagggtggcctgggcagcctgcacggcctgcatgctggagttaatggttccagtgagtgcctgctgggctgaagtcagaggaggcatgtgtcctcggtgcatctggccgctggtaatctgctgctgggcagggggcatgctgcccacctggaaattctcaggaccagaggctccagagcgcatgatggcaggcagggccacagagccatgctccactttccccacccggttgtattgctgctgcaggactgttgactttttgggggacactgagtcctccagcatagtagactcctcatctccttccagcccaaagtgatccttgctttttttcttcttcaggatgatatcgatgtagccggcaatgagctgtgcaatctgctccccttcagttgtctgtactgagtaatagccatcttggtaatctccaaaatccagggtgaagcttttgggagacgcagcccagcgtttgatgttggtgaggttccactcctggatcacttccttggtcttctcatccactcgcatcacacactccttggtgatgcccagaagcctgggaacttagcttgttcttccctttcattttttccttcaccagggaagaaggagacaccgtaagtctttgaggagaacgggctagctttcacgtaggcggaccttggcctcaatctcacttcatctgcccacaattcttgtgtgcctggaagatcttacgctctcccttctgcttcacatactccttgggcaggaagtccttcaggtcaaggaagccagccttgtgcttctgctcattgtggggcccaaactggatctggcattggaagccagcaaactcacaggccttgtcaaaggagacagggtgggagccattcaggatgtcatctcgtgcctgcacatacaggagggtcagctgtacagggtcccgggaatccacattctggtctgagtaaaagaacttcctccgcagcagcagcgtctcgtgctcctttacaccctgctccctcagtgtccgaccatggtccagccagttcaactcatcaatctgtgcgaattttctggttagtttctccatcttcttttcatctcgcagcaatgtcttgtcctttcttaaggtacctgttatttcctcctttttctcttccatcagctctcgaaccccaatgaatattcattatgattggtgatgccaatgcgggcacagatggtcatgagcatgtcagtgacagtcttagagtcatccaccatgatcgtcttcacagttccatccagcatacggatcttcaggggtctctgtttcttcctgtactccatagtgtccccatttcggagcatgtagtagtccaaagctttcccagcctccagccatataccctttttggggtcatcatctgacagaaagagcccaaagtcgctgggaggaccagctggggcctctgggatccgctcacgaatgatgcggcagggcgtcgtacaccatggtagacggctcaaactgcatcgtcttcaccacattcccaatgctgatcttcagtgaaagtgcaaccatggtggcagcttcttttctccagcctggctatacctgcgctgcctggctctg

SEQ ID NO: 3530 - DNA, 2446 bp, Homo sapiens
ttttttttttttttttttttttgggtttcacaatacatttatttaaaaaagcaacatacaggtaataggtatttcagagaattcagcaaagtataaagacaaatacaaaagatgcttgggatacaaccgctagcttctgccttccacacacagtggatttttacttgtaactgaactagagttactctggttgccaactaaagttccgaagccaagtctacggcccaccaacttggaagctgtggcttatttcttgtggacttgacgttacactggggcttcattgttctttcatttaaacaaatttgaacagggaccggggctggggggacacaccggggaaccgacaagtggggtcctcctggcccatggggaacttcacaattcttaacagcgagacgaggccacaaacgggcttaggcacaggataagcataacaagttgccacccaaggtacagggctcaggggtgctacggggacctggcaagaaggccacctgagcttcgggtagcctggggaaggcttcctggaaggaagtgaaggcccaaagttggggggtgagcctgggccaggcaaaaggcaggcctctcggcgcccatctgtggttcctcaacaccctgtgtgtgcaggcccctcagctgacctgtcttctgtgaaattcttgatcccgctctgttctattcacactgtgctgctttgccttggtggttagcatggttagctttcacaagcacaagctcacactcgaaaactaggctgctgtctcctgggagtttctttttttttttttttttttttgagacagagtctgtgaatgcctaggctggagtggcagtggtgtgatcttggttcactgcaacacctcctgggttcaagtgattctcctgcctcagcctcccgagtagctgaagattgagattcacaggcgtccaccacacctgactaatttttgtatttttagtagagacggggtttcaccatgttggccaggctggtctcgaactcctgacctcaagtcatctgcccgccttggccacccaaagtgctgagattacaggggtgagccactgcgccctgacttggaggttctcttacatttggtattttttcatggacacctatgactatgctttggaaaaaattggcttgcccccacgaaccctggctgggaccaagaccatcaagcacttctcccatcaccaggctgaagccaggatgaggtgggtggttcgcagtaggtgaaaaggggccaaagatactcaaatgaaagccacagaagccacacccatgaggctgctgcctgggcagaaggcccagaataccctcctaaatgggaaaaacgcaaaggcacacagcgatcatgtcaagggccagtcatgtgaaagaaagaaacaaacaaacaagtatcttgccacaaccccaaactacagacaacagggcgcattcccctcatgaacttcccttagggacttgcgggccccagggcttgtgtcgctcagtcaaaggtgatccggaacgtgcgctcctgctccttgcgccggccctcgcacaccttggtcacctcctccaccttcctattcagcagggccgagttctggtcgatccactgcagtgagtccatgtgcgcattgaggatcttgcagatctgctgcagtgggtcactggtgtcggcgggggccccggacgtgttcaggtgctcgatgatgtccttgagatcctgggccatgcgcttgagctgtgcgtcgatgttctcagccagcttgtaggttttctcacgctcctcatccgcgtgctgcaggtagatggtcaccctctgctccttgaccaactcctccagtgggctcagcaggtcttcgagctccttctgctgggacaggatgaagtcgagctcctggtccagcctcttctggtccagcttcaccttcatccacctcgcggtgcaggctggtgatcttttctccattctcgatcagcgtgcggtcccaggcgttgacctgggtggcctgctggaggaagtgccgctcctggtcctctagctccaggctccatttgttgatcaggctctccacgtgcgcgtaggtcatggcggagctggcagccgcccctgcagctgcgccagggccaggtggaggggtcacggcagctgctgtattgctggggatccccgctggcgccagtggttttaaattcaaggcaaagccggtggtgctgctgctggtggtggtggtgccggtggcggtggcagcggtggatgttgttgtggaggtgccggaagctgctccaggtgcctttaagctgaagccctgtgtcccagcagtgggggcgcccgctgtggtcacaggggtacagagggagagtccagtggtggcagatgaggttggagcagttgctattgacgcaaagaggctgggcccagtactggtgatggtggctgtgggtgtggga

SEQ ID NO: 3531 - DNA, 6046 bp, Homo sapiens
tttttttttttttttttttttttttttttttttttattttcaaaaacaactttattcatgacacatattaaaaaaaaattcccacccctggaaatgagctaaaaaaataaacaaaatccacctcccacctccctgttcccacttcctcccattccctccaaataaaagggaaaaaaggcaaaggaaaaaaaaaaaaaacaaaaaaacaaaacaactgaaaaacataaacacccctaaaccccccaaaacaaggtagtgcatttttcccagggggaacggggaatttacactggaagccgctgggagcggaacggagatcttccggctacagaaaccttgcaaagaaagacactcaaaacagaaaaagaaacacaaaaggaaacaaaatagatcaccaggcaatctggaggggcagggagccggagaaagaggggttgggttgggtgttagacctggctggacaggagcaggcaggaggggaactgtgaaaggcgaggagaagacgggagggaaggtaacaagcagaacaagtttggtgtcctttccagagccctgggtaaaaaaaaaaaccttcctaccacccacgcccacctacccttgagcaggccccaagggggtgaagggggcagggaaacatgggcaagcagcttgcgcagttgagacgtgtccatggcgaatccccagagtgaataagcagccccctgccccactccctgggccttcccctactccccaaagcaggtccctcctcagcagttagttatgggattctccccccttccacagtatatcttttttttaaaaaatattttttttccatcaaggtcatcttctgtttttcttttttttttttttaattctttttttttttccttctttcctctttttttcctctctctcctcctaatacacacttttttttagtaaggggaataccatgatgtcgctctagcccggcccctggaagaaagaaggagagttaggtgttaacgtgatcactagatagttcaagttacaagccccctcccccgtaagccccctgccccccagttaactgtgaaagggcaaggggggaaaaagaaagtgtttcaagtgtccctaaaactgacccccatgatccccagaaatagtaacgcaccctggagaactggggcagggggaggggggcttaacagaaaactcttgccaaacagtggcgaaaaagaaagcgcatctgagtgagagacagggggccaaggaaaagggaccccccctttttaatccagtttttcagtcctccacagctttttaaaccctagggccatcacaaatagatcctccctaactcctggggataggcaggtagagcttatgaaaagcccaaggtttatatgccctaacccgtcctatttaaatgtagagacagaagtgaagcaaggcaaaaacctgggcaccacactaggcccagtgagaagttaaccttgcaagactggctcaaataaagaataagtatctcaaaatcctcccacaaggctgttgggaggatcaactagctagcctctggtattcttccaagggaggttcagtcttcaatccctccctaactccgaaaaaagtaacaaatgtccaagcagtgctttcaacttcctggaggccctgttcctcccagttttgtccgcaaacaccttcaaatgccaccaactcccaagaaaaaaaaggctgggggtggaagcctctttgaaccaagggagggatgcagcccttatcaccaatttctactgcagaaaagatgatgaggctgccttctggcctggcctgcaactaccttcctcaacctgcacaggcaggagacaaagttcctgaagaccacggggaggggtggggggagggaggttcctcagaccagagaggaggaagcatacggggctcacgggaggcgggggaaagaggagcagcccatctatcctgacctgtagacgcgaccccggggcctgctgttaaaaccactgtagaatcgagagcgggagctgttgtagttggtggtccgggcgcggtagcgggctcgtggaaaaccccggtctgttgtgctgatgcctggtctgttggttcgttttgggatcacctgagtcagagatgaacaaatgatagccttaaaggcaacctggagagtttatacacaactagaacagcaatggacataggcttaccttgatttgccttcctctaaatagggactcatctaaggccaaggaagtcctcactgactctttgtctgagaactctatatacgcaaacctgaaaagaattgtcattgtatctctctgaggttacaaatacctcacaggtcaaattcaacctgcaggcatgcttcgttttgggctacaatgcagttatattttttatttgtcaaaattcttctaaatggaaaatttcaatcattcgaaatcatttaaattttaaaatttccagctactctttgaaatttgtaaaaataagacacacagggcctgaatttccatatgccataataggccaagtagaagctgcccctccccttctagttcgtaatcccacccacatctagccttcatttttgttatctggcctctgaagacatttaggtgcaactcctgatatatcaacattaatgccatgatcttaaatgacacagatcacctgtgttaacaccaaataacttactgctcaatataaaacataatttatctatttgtacactgtaatttaaattatctcaacttactcccctttactttacctttgggatggccactaaatttgtcacacagtatggtaacacggttgactgaaccacagccatgaaagtgagcttccagctcttctgctgttgcaccatagtccacctgatgagaggagaaaaatttcacaggcaccaggcaaattcctgtctcaaaagaaccctcccgagcctttggtctgggccatcatacaccaaagcacatgaaatctggtaatttgaggaattaatctcttttccttccaaacccagagcctttgctgattactgatcattccattacctttaacctccttcccacactccctccacacccaaaaccacatctatcccggagatgttctttcaggactattaaataattccccaaaagaagaacttgcccccaaccccagtcagagccccagtacgtcacattgccaacatagatggaacgggcatcagcctccatcttctcctcaatggacatgatcaccgggccagctatcaggaaaaaataattttttacaaaaaccacacacttgttttctacttgaccaatatgttgcacttccaccaccagcactatcccataagctcagtgaaggcaaagattttggtctgtgctgttccctgctgtacccacaagccgagaatagtgcctagtgcatagcaggttactcactaaataattcgataaattgaaagaattaatacacacttaaaacagtataggaatccctcctgccctccaaatcaaatccctaatgaatggctttggttgaaatgcttttaagagtgagcaaaattaagtgggctgagactccacatttctagaatttaaaggggaaaccccttccagcttgctttctcttagaatcctaaagcgtctccaattggaggaaaaactattagatttgaaggtcaaatgcgagcacgcaacctctaccaaagaaagatagacgtagactaagaataaagagcaacacaattataacaggacaaagggaggcacaaggctaccaccaccaaaatatcagttctgcctcacaaaggtcagaggaacacacaacggactatgaccgcggcacagtcataatagctcagacaagcagctccagggtgccgagtatctaaccccacattccccatcctccccacaacccttccaacccgagaacccgggctccgcgtgcaaccgccagttactcagcattgcctggaggtggactcatattcatctgcttctctacctcgttctgtagctcctttagcttctcagcttcttcctccatctccctgactcgagctttgatagcttccagctcctaatataagtggggagggtatggaggacagcttaagaggaaccaacgcaggggctgtgccctgctctcggccagagcgcgcctcagccatgctcggccatttccctcgccccatgcgagggtcgtgataaaagaaaagctaccctctctagaacaacactaggcacccgtgacgcccgaatcaagccagtcgggccccttgtagtgatcgctgacccatccccggcccgacccgccccagccacgttattccccgcccaaccccaccccccgcctgccaccgctcgcccgagctctgggcctccagtgacgcgccagccgccggcctgctcgctcgccctccttcctcaccgggtcctcaatggcgccgtcccccgggtcaccctcgaccagtcccggctcctcctcctcctcttggctgccgggggctcccgaaccaggcccagggcccggagctcccgggggggcgcggggccggggcggctcctcttcgggctcgggctccggctcgggctccagcagcagctcctcaggctccagttcctcagactccaggccgttcccgtagtcccctgcgccccccggggccccctccccggcctccccaccggccccgggcacaagatggcgccgccgccccggcccggagccccgaccgcccgcagcccccgctgctgctgccgccgccgccgccgccgccatcgccgctcagactggggcccgccgcccggcatgtggagagctgcgccggccacggaggactcattagctcaagctgcctgcccgtcaccatgagctagtactccattggggaatattacttggcaatcaaataagcgcacctctaaggcgggcactgcgccaaattctcaaatcccggtagggaaatctgcctgtcaatcaacacgcgtcccacctcctatcgagtccttaggtaataataccgccacgctgtgacgatattcctgcttctccccggcctacgggcgggcccgcgaagtatgggacgctccgtgattggccctagctaggcgactggaaaggaccaatcttccgatcgcctcaccgcagtggcccagtctcagatgccgattggcttgcgagagtcgaaggggtgacactcgtttcgtgacaggtgaaccttgcccccgaaaggactgccgggcttcaaacttgggaaacccgaggtcacatgactagccagtcctagggggccgccatcttgatactactgcttgccagctagtgagctgttggccgggtgaggcccaaaacagagcagcagtttcaggaaacttgtatctcgaccaggaagcaccagtagatgggatgttgctgaaaatggaggttgtgaatgaagcattccaggagggagcttactttccccatccaggttattggcaccatcatccactagctctcccgcaccagaaagcagggaggattcctcagtccagagctactagtcacaagtcctgtctgtcccgccctcttgcgtaggccttctgctccccagttccattttctttttcctggacagcttccaatgtcacccctccaatctgcaccgctaacagactggcccccctttgctggcgaggtaaagtctcaaaaccgtaaatcacggccttcgatacgccagcatgtggttactttgtggatgttgtttccttccactcttctcgttcctttgggtgtacctgcacccagtctgtgcctctaacatgtagtcccccttcaatcaaaccactgcaaaccccagcttcccctcatttcccaggacaagtgggcctatgtccacggcgcgcttaattgttttactgtttgctaactaggttgtgagcgcctgcagatgaggggcggttcctatttatattcgcagtctcacggcctggcaatatgctaccacatagatgtgctgcttagatgtttggttgattgaacaggcatttgtattggggctatttgggtgtccaccttcatt

SEQ ID NO: 3532 - DNA, 1790 bp, Homo sapiens
aggggcaaggggttttatttccaacatgggcagaccgagaaggcgctgtttcatcgaggaaatccccgacgagacccatggtcatcggcaactatcggtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacacgcccggtgaccatcaaattctgtctgcactccaattcttaccaggatggctctcttcgctggtgggcaaactgcgtgtgcatcttcgacatccaggtttggggagcatgccaaacaaactaccctgagattgcctgcaaaagataaagctgacggaggctaacagctccgcgcgccgcccagttgctttgatcaggtggaacagattcagaaggagcaggattacccaaaggtatcgtgaagagcgcttccgactgacgagcgagagcaccaacccagagggtcctatggtggtcccattgctcagactgtcatcctcatcctcactgggcatctgggcagatgcgttcaccttcaagagcttctttgaggcccaagaagctggtgtagtgcccctctttgtatggacccttcctttttacctcattttattttggtacttttccccacacagtcctttatccaccctggatttttagggaaaaaaatgaaaaagaataagtcacattggttccatggccacaaaccattcagatcagccacttgctgaccctggttcttaaggacacatgacattagtccaatctttcaaaatcttgtcttagggcttgtgaggaatcagaactaacccaggactcagtcctgcttcttttgcctcgagtgattttcctctgtttttccctaaataagcaaatgaaaactctctccattaccttctgctttctctttgtccacttacgcagtaggtgactggcatgtgccacagagcaggccctgcctcactgtctgctggtcagtttattcacatatttttggtaactcccataggcagctcctaggatttcagcggtctgtgggccagaaagcaggcaccagggctgactctcaaggccgtatcagtagggccaagcagagttcttttgggatacctgctttttcatcccacagggcctttagagtcagaggtaaggtatgtctatacagagcttagaatgggggcaattgcactctttaccctccttctcaaacttttatttaaagcttgtgctaaaatgttttcttcaaaggggaaccaagatttaagttctttaacagatttttccagtgaaataaaaacatgttgtaatagctgtgtttgagaatgaaataaggaggttgtggggtagaggggagggcaccctaaagggaaaagagggaaaggtgccctgggcttacctatggcagattaacctgggagtggaccttcacctgtggacctcgtggtacctaaggcttgccccggacaggcagtcctagggggtatggggaatacacggtgtggttgttcaactatttgcaaaggtcaacccaaatagacccacatgttccgcaaagtatcatctgaggaaattaagtaccttcttagccctctcagtcataaatttgaacaaattttaatacacttccctcatgcccttctatataaaacttaataccattagttccccattccttggacatttttattttcagtttttaattatatatttatttgaaatatttaatt

SEQ ID NO: 3533 - DNA, 1788 bp, Homo sapiens
  misc_feature (1)...(1788): n = A,T,C or G
gaccatgattacgccaagcttggcacgaggttttttgtgaggattgggatattccgactccttaagggcctggcgcacataggtgtgaccttttcattcccgttgttatggagggccacatctgccagagcctgggagtctgcgaaggccgggacccggttccccggcccacagtgggggtgtgcaaacccgagagaactgggaagtgccgtcagaagcgataactgacgacgtctaatgtctatctgaccgcagtcgctgaaacctctacaacttagttgacccgtaactgccagagccctgccctgaattcctgtccttactccctctttaaggattgcgtacccactggcagagtgctttaaggacgggggtaggccacgaggttgcaaattcgtgaagaatcagcaatcatgtttgggcagctgagtattgggaagccaggagccctgccatgaaggtttttgagaaccagagtgcctgttttagaagctgggcaagcagcattctcaggcccaagaagaaggttattattttccaggagggatgttcagtcccaagggaccagttagctgccatcagtttggattcctgaaaactaactgggcatcaacactgggtgtaagaaacaatgcttggccttaatgtatcagaaggacatgcttcagccagattccaagagatatattttgggcaacttttttctaggaaaagggcacatttgggtattcattccattaaaattcttgagttttttttggggttttttttttttttttttttgagacagtcttgtccgtattgcccagggcttngatttgtgggtgggcacaatcacagctcattggcatcctcaaatcaccccagggcctaagcaaatcctccccaccttgtagctgggactacaagctcacagcacaacctggcttaaaattttttttttgttggagacgggtttctccatgtttgcccaggctgggtctcaggctcctgggctcagatggtccctcctgcctcagcttccaaaggcacagggcccaagtttgttagctttgtcccttgcccatcatgcccaacgaagaggttctataccttttaatgaattgactttcataaattggttatgttggtgggcaagttctttaagctggaaattgtaaattcctcctgaaatgttttttcatgcagttacccatgaactaatactacaatcaaaggatgggtcttggggtgtcaattcttggaaaatgtgtatttgaagaaaaagtaaaatttcgcctaactgttgtccagatattagcagtcccagatattcgctctagcttgtaaacttccctgtggtcagcctaagctcttaaccccctattctacagctttagactgaaggcaaaagctctaaagctatttaaggcctcctcaaatttcggcccctgctgctctgtgctctgttccttgggtgtagctttgttccagctcctgcaggcattgcaccattcctaaccacaaccttaacaggcatgtaggggccccatacttctagggccccatcttgctgtcttcctgtgttgggaattttggcctaccaaggcctgtcaagagggggtcctcccccatactgttttggcccacaagggttcaagagtggattgggctcccagtcttcctggactgaactacttggatctaggggttgcctgttatttagaagagatcccttaactggtagggccctttcagtaggacagtatttgggtaaggggagggtataagatgagaacctttgctaag

SEQ ID NO: 3534 - DNA, 4118 bp, Homo sapiens
ccaagggccctgttgccgtggcaaccccggcctctctgtgggaactttggggagactggccctgggaggcgacagatggaggctgaggaagcagagtgatccccggccccttcctgtccctgaacactgtctgcctggatgagggctgtctgccctgccctgccgtaggagatgggctgggagcctcccacgctctccagctcactcggcaggcagcgggtaccaggggctggcaggttaagcctctgggggtggatcctgaaaggtgggtccagccgcctggccctgcgtgggaccctccacctggcagcaggtacccaaacaagggctggacagcagggtctcgctctgtcacacaggctggagtgcagtggtgtgatcttggctcatcgtaacctccacctcccgggttcaagtgattctcatgcctcagcctcccgagtagctgggattacaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccaagacacacaggagcaagcctccactacaaacccacaccagacctgcgcatctccatcgagaacttccgaagaggccctcacagtccatgcccctttccctgcagcccaccctgcttcccgatccttccctgaccccaggggcctctaccacttctgcctctactggaaccgacatgctgggagattacatcttctctatggcaagcgtgacttcttgctgagtgacaaagcctctagcctcctctgcttccagcaccaggaggagagcctggctcagggccccccgctgttagccacttctgtcacctcctggtggagccctcagaacatcagcctgcccagtgccgccagcttcaccttctccttccacagtcctccccacacggccgctcacaatgcctcggtggacatgtgcgagctcaaaagggacctccagctgctcagccagttcctgaagcatccccagaaggcctcaaggaggccctcggctgcccccgccagccagcagttgcagagcctggagtcgaaactgacctctgtgagattcatgggggacatggtgtccttcgaggaggaccggatcaacgccacggtgtggaagctccagcccacagccggcctccaggacctgcacatccactcccggcaggaggaggagcagagcgagatcatggagtactcggtgctgctgcctcgaacactcttccagaggacgaaaggccggaggggggaggctgagaagagactcctcctggtggacttcagcagccaagccctgttccaggacaagaattccagccacgtcctgggtgagaaggtcttggggattgtggtacagaacaccaaagtagccaacctcacggagcccgtggtgctcaccttccagcaccagctacagccgaagaatgtgactctgcaatgtgtgttctgggttgaagaccccacattgagcagcccggggcattggagcagtgctgggtgtgagaccgtcaggagagaaacccaaacatcctgcttctgcaaccacttgacctactttgcagtgctgatggtctcctcggtggaggtggacgccgtgcacaagcactacctgagcctcctctcctacgtgggctgtgtcgtctctgccctggcctgccttgtcaccattgccgcctacctctgctccagggtgcccctgccgtgcaggaggaaacctcgggactacaccatcaaggtgcacatgtacctgctgctggccgtcttcttgctggactcgagcttcctgctcagcgagccggtggccctgacaggctctaaggctggctgccgagccagtgccatcttcctgcgcttctccctgctcacctgcctttcctggatgggcctcgaggggtacaacctctaccgactcgtggtggaggtctttggcacctatgtccctggctacctactcaagctgagcgccatgggctggggcttccccatctttctggtgacgctggtggccctggtggatgtggacaactatggccccatcatcttggctgtgcataggactccagagggcgtcatctacccttccatgtgctggatccgggactccctggtcagctacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgaccttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagactgcgccaggctccccatcagctcgggcagcacctcgtccagccgcatctaggcctccagcccacctgcccatgtgatgaagcagagatgcggcctcgtcgcacactgcctgtggcccccgagccaggcccagccccaggccagtcagccgcagactttggaaagcccaacgaccatggagagatgggccgttgccatggtggacggactcccggggctggggcttttgaattggccttggggactactcggctctcactcagctcccacgggactcagaagtgcgccgccatgctgcctagggtactgtccccacatctgtcccaacccagctggaggcctggtctctccttacaacccctgggcccagccctcattgctgggggacagggcttggatcttgagggtctggcacatccttaatcctgtgcccctgcctgggacagaaatgtggctccagttgctctgtctctcgtggtcaccctgagggcactctgcatcctctgtcattttaacctcaggtggcacccagggcgaatggggcccagggcagaccttcagggccagagccctggcggtaggagaggccctttgccaggagcacagcagcagctcgcctacctctgagcccaggccccctccctccctcagccccccagtcctccctccatcttccctggggttctcctcctctcccagggcctccttgctccttcgttcacagctgggggtccccgattccaatgctgttttttggggagtggtttccagggagctgcctgggtgttttgctgtaaaatgtttgtttaattgcacaagcctcggcctggcccctggaggccaaggttcggtaaccgatgcgtgggcttgggtaaggtccctctgtccatctggggcctttgtatgagctgcattgcccttgctcaccctgaccaagcacacgcctcagaggggccctcaagcctctcctgcaagccctcttgtgggcaagaactttgggaccatgccagtcccgtctggttcccatccccaccaatcccaaggactgaagactgaccttcctctgggtgacactgggcctaggagcctgaaactctccccaaagagggttcttctcccaaagccccccaaaatagctccccagggcgcccctcggccgccccatccatgggttaaatttttgttccaacaaacacacacgggtaggatttgctgggcctgttgtagggtgggtaagggaccgcaagatgacccgaccctggtcactccctccctgcccaacattcagtcctggtatgtgaaggccgtgccgtgaagcaagaactccccggagcctacagggaacagggagcccatcattccctgcccggggaatccctggaagacttcctgtcaggagtcaagcgttcaatcttgacccttgaagatgggaaggatgttctttttacggaccaattcttttgtcttttgatattataaaagaagtacatgttcattgtagagaatttggtaaactgtagaagagaatcaagaagaaaaataaaaatcagtctgttgtaatcccctagcaaaaaaaaaaaaaaaaaaaaaaaa

SEQ ID NO: 3535 - DNA, 2530 bp, Homo sapiens
  misc_feature (1)...(2530): n = A,T,C or G
cgcgccccgcgtccccgcgcagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaacaccagtgactgcagctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagcgctgcgaccgtgaaagccaagacggacctcaagctctgggggatcgacagggacagctaccggcgcatcattatgggcagcacgctgaggaaacgcaagatgtacgaggagttcctcagcaaggtctccatcctagagtccctggagaagtgggagcgtctgaccgtggcggatgcgctggagcccgtccaattttaaagatggagagaaaatcgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaagccggccccgggcggccactgtcgtggcccggggggcccctcaaggtgtgtgaagctggaccgcgccccgcttcgagcgtgtgctggggccctgctctgagatcctcaagaggaacattcagcgttacaacagcttcatctccctcaccgtctgagcacagctcccgccctgcagccccagctccccagggtgtggtggccgtgccctgctcgtctgtgtcgggggcccgggagccgctgtgttaaggtgtgggccgggtggggccncggtcccagcaagcgctgaggacttgccccttccccggactcactttttgggaataaatgatcaccttgtgcaatttccaaaccaagagccagcgggcacaaaatgcatcccaggatcaaggaagggacaggccaggtttcctccccacacgccctccccggcttgccttctgtgggctttcttgcttggggggcccaaccccaacccctgccaagtctccctggaagatgctttgaggaatcggtccctccccaagaaaccaaggcccagggacggtttccccttggggccctggtgacccttgtgaggtcaggtccccccagatttgaggtctgagtgtgggcaaagtgtgtcaaaaaggggcttgccccccaggggagatgaggctgagagcagggagttgaggccgaagaagtcaaggcccctcccgcaaagtgtgtacccctgcccgcgccacttgcaccccgccgcacccccacctgcccccgggggccctgctgcggatgccgggatttgggagagttctctgagctgtgagattgatcttgcccctaattggagaggaagccgggcgccaagatcacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccctgacccgattcaaccgacttgtacacttaaatgtgtcttggaatcccgcagtgtatcaagtgagcgcagccaggcccgaaagggtgaaggccagtgcagagaagccttcccaggggattcctggggttcccccgaaagacaagcgaggtcattgcagttcacctgattgttgctcctgtcccgttgcgtccctggggaggctgtccttgggtccgagggttgcttgtttgcagccccttcccctgctgggcggtttacgattgcgtgggggtccccctccccccccaaggcccccggcaccgtcgccgtgtcccgcctgtgcctgtgacgtccctgtggacctgtgagccacccccccccttatctctgttctgaatactgcatgaagcattaaacgtgcaatgaagta

SEQ ID NO: 3536 - DNA, 1363 bp, Homo sapiens
ggcacagtaagtactttctgtgccgctactgtctatccgcagccatccgcctcttctttcgggctaagccgccccggggactgagagttaaggagagttggaggctatactcggacacagggttcctactcgccccttgggccttccggacaaaatggggtctgcggttggtgtcctggcaaaagcagggtagaagggctgcggggcgggcccagaatccgagcctgcagagatgggagcagttgcagtgttgagggcggaagaggagtgcgtcttgttttgggaactgcttcacaggatccagaaaaggaaatgcccggcgaagccacagaaaccgtccctgcttacagagcaggatgttgccgccagccccagggctgagcaggggtttggaccagaatctgaccagtgatgaatcagtacagaggcttgaagaccaggattccacccaggcaacacacaacaaagcccaagctggcggcagcagtctgaaattgatgaagaaccagtcagttaaggcaaaacagagtcggagttgaaaagaaggcacggaaggctatgtccaaactgggtcttcggcaggttacaggagttactagaagccctatcccggaaatctaagaatatcctctttgtcatccaccaaaaccagatgtctaccaagagcccctgcttcagatactttacatagtttttcggggaagcccaagatcggaagatttatacccagacaagcacacctaagcagctgctgcagaaattcaaagttcaaaggtgaagctgtctcaaacattcacagaaaacacacaggactccaactgtacaagaggagagtgaagaggaaagaggtccgatgaaaccaggtgtaggaagttaaggacatagaattggtcatgtcacatagcaaatgtgtccgagagcaggaggcagtccgagccctgaagaacgaacgagtaatgatattggttaaattgccgattatggtaagtgttcaagcctttgttccttgactccctctgccctgaccaattatgagtgactttaatttgtccttgcctaaatatcagcccaattaaggaacctcattccagagcctcttctgagttgccgtataggttttagtggcctaaattctcctgatttgcctgtaagagttttagtgacctgaattctcctgatttgcctataagaaccgctaattatcttttctctgttacaggaattaacaatgtaaccatatggaagcaactttttttggtgtctcaaaggagtaactgcagcttggtttgaaatttgtactgtttctatcataaataaagttatggcttcttgttggaaaaaaaaaaaaaaaaaaaaaaaaaaa

SEQ ID NO: 3537 - DNA, 1825 bp, Homo sapiens
cccccccccccccccccgagcagccagcccggcccgcccgcgcccgtccgcagccgcccgccagacgcgcccagtatgagggagatcgtgcacatccaggccggccagtgcggcaaccagatcggggccaagttctgggaagtcatcagtgatgagcatggcatcgaccccagcggcaactacgtgggcgactcggacttgcagcatggagcggaatcagcgtctactacaacgaggcctcttctcacaagtacgtgcctcgagccattctggtggacctggaaccctggaaccatggacagtgtccgctcaggggcctttggacatctcttcaggcctgacaatttcatctttgggtcagaagtggggccggcaacaactggggccaagggtcacttacacggagggggcggacttgggttggattcggtcctgggatgtggttgcggaaggagtgtgaaaactgcgactgcctgcagggctttccagctggacccactcgctggggggcggcacgggctccggcatgggcacgttgctcatcagcaaggtgcgtgaggagtatcccgaccgcatcatgaacaccttcagcgtcgtgccctcacccaaggtgtcagacacggtggtggagccctacaacgccacgctgtccatccaccagctggtggaggaacacggatgagacctactgcatcgacaacgagggcgctttacggacatctgcttccgcaccctcaagctggccacgcccacctacggggacctcaaccacctggtatcggccaccatgagcggagtcaccacctccttgcgctttccgggccagctcaacgcttgacctgcgcaagtgggccgttcaacatggtgcccttcccgcgcctgcacttcttcatgcccggcttcgcccccctcacagcccggggcaagccagcagtaccgggccctggaccgttgcccgagctcacccaagcagatgttcgatgtccaagaacatgatgggccgcctgcgacccgcgccacggccgctacctgacggtggccaccgtggttccgcgggccggcatgtcccatgaaggagggtggacgagcagattgctgcccatccagagcaagaccagcagctacttcgtggaggtggatcccaaccaacgtgaagggtgcccgtgtgtgacatcccgccccgcggccctcaagatgtcctccaccttcatcggggaacagcacggccatccaggagctgtatcaagcgcatctccgagcagttcactggccatgtttccggcgcaaggccttacatgcactggtacacgagcgagggcatggacgagatggagtttcaccgaggccgagaagcaacatgaacgacctggttgtccgagtaccagcagtacccaggacgccacggccgaggaaagaaggcgaagattttacgaagacgacgaggaggagtcggaagccccagggccccccaagtgaaagctgctcgcagctggaagtgaagaggcaggttggcggccaggggccgaaagccagcagtgtcctaaacccccgggagccatccttgctgcccgacaccctgctttccccacgtgccctagggctcccttgcccgccctccttgcagtatttatggcctcgtcctccccacctaaggccacgtgtgagctggctcctgtctctgctcttattgcaggctcccaggcctggacgttttacggttttgttttttaacctgggttttgtggtttatattttcgggggatacttaataaatctattgctgtctagatacccttaaaaaaaaaaaaaaaaaaaaaaaaaaaaa

SEQ ID NO: 3538 - DNA, 6399 bp, Homo sapiens
ccggagcgggctcgccccctctgcttccgccgcccagcccgtgatcgctgctccgcggtccccggcaccctcggccccccacggcggttggatccggcgggggaaggagaaagtgagactcggtgtcatcaccaatccgtcgccagaaggggaggaaactggaatccagcagcggcgagcagcagctgggcggtcacatctggaaatggaaagccgacctccccctcctcctccacctcttcctcctcctcctcctcctcctctcacccaggatcacttccgaaaccactgtgccttcagcccctgcctcggccagaggtttcatttttaactgaatatttacgaaagctgaaagcgtgcgaggggggtggggtggaaatagcggctgcttcttttccaaggatttatttaatggggatgtgttcaaggcaagaccgaattcagaaggatatcgacgtcgtgatccagaagtccagagctgaggactgcctgtttgcagatttcaggagtgaaggcaattttgaaggcatgactacgacctgctctggccacaagagctaagagttgccaggtgttgtggctcaaacactttgagatgccaatcccaacactttgagaggccaaggcaggaggattgcttgaggctaggagcttgaaaccagcctgggcaacacagcgagaccccatctctacaaaaaataaaaaaacaggccaggcgcagtggcacttagggaggccaaggtgggtggatcacctgaggtcaggagttcgagaccagcctggtcaacgtagtgaaaccccatctctactaaaaatacaaaaaatttagccaggcgtggtggcgcacctataataccagctactcgggaggctgaggcaggagaattgcttgaacccgggaggcagatgttgcagtgagccgagatcacgccactgcactccagcctgggtgacagagtgatactaccccccccaaaaataaaataaaataaataaatacaactttttgagttgttagcaggtttttcccaaatagggctttgaagaaggtgaatatagaccctgcccgatgccggctggctaggaagaaaggagtgagggaggctgctggtgtgggaggcttgggagggaggcttggcataagtgtgataattgggcctggagatttggctgcatggaggcagggctggaggaactaagggctcctatagattatttccccatatcctgccgcaatttgcagttgaagaatcctaagctgagaaaggggaggcatttactccaggttacactgcagcttagagcccaataacctggtttggtgattccaagttagaatcatggtcttttggcagggtctcgctctgttgcccaggctggagtgcagtgacataatcatggctcactgtatccttgaccttctttctgggctcaagcaatcctcccacctcggcctcccaaagtgctaagattacaggaatgagccaccatacctggccctgaatcttgggtcttggccttagtaattaaaaccaatcaccaccatccgttgcggacttacaacctacagtgttctaaacattttatatgtttgatctcatttaatcctcacatcaatttagggacaaagagccccccaccccccgtttttttttttacagctgaggaaacacttcaaagtggtaagacatttgcccgaggtcctgaaggaagagagtaaagccatgtctgctgttttctagaggctgctactgtcccctttactgccctgaagattcagcctgcggaagacagggggttgccccagtggaattccccagccttgcctagcagagcccattccttccgcccccagatgaagcagggagaggaagctgagtcaaagaaggctgtcagggagggaaaaagaggacagagcctggagtgtggggaggggtttggggaggatatctgacctgggagggggtgttgcaaaaggccaaggatgggccagggggatcattagtttcagaaagaagtctcagggagtcttccatcactttcccttggctgaccactggaggctttcagaccaagggatgggggatccctccagcttcatccccctccctccctttcatacagttcccacaagctctgcagtttgcaaaaccctacccctcccctgagggcctgcggtttcctgcgggtctggggtcttgcctgacttggcagtggagactgcgggcagtggagagaggaggaggtggtgtaagccctttctcatgctggtgctgccacacacacacacacacacacacacacacacacacacacacaccctgacccctgagtcagcacttgcctgtcaaggaggggtggggtcacaggagcgcctccttaaagcccccacaacagcagctgcagtcagacacctctgccctcaccatgagcctctggcagcccctggtcctggtgctcctggtgctgggctgctgctttgctgcccccagacagcgccagtccacccttgtgctcttccctggagacctgagaaccaatctcaccggcaggcagctggcagaggtgggcaaacacctagtctagagttggggagggctgtccgtgagggtgttgagtgtcccagagaggatgcagggcctcagaggagatgctttaggggtgtgttggtggtgatgggcgtatctgaagaacagaggtgtccagggttaggcagtggggggtcttgtggaggctttgagcagtgatggccagaaatgggcaatggggctttcctaggtgggaaatgggaaatggtttggggtgggggaggcattggagggttctggggtaagcataggctgggagtgaacaggggcaaaccttatgcagctgtggggtagaaatgggctagaggcatccaggggtgagaaggagctgaggatgtctaaggaggggagatccctgggtggtcagaaagcactggtgtctggaaagcatttaatgctttattaaatgctagtccctgctgggcatgacggctcacacttgtaatcccagcactttgggaggctgaggtggtaggatcgctgaagctcaggagtttgagccagcctaggcaacatagtaagatcctgtctctacaaaaaaattaaagaaatagccaggcacagtgatgtgcacctgtagttccagctatgcagaaggctgagatgggaggatcgcttgagtccaggaggtccaggctgcagtgactgtgtctgcactgtactgcagcttgggtgacagagcaagaccccatctcaaaaaatatatatatatatatcttctgattcagctcattttctgtgccttttgagatcttcttggacttttattctttcacccagtgtatttaatattactctctcccagctgcttttatctgaaaactttatcaacctgtgctttatattttcattcaattcatttataaaaatgtcacatgagaaagggtcaagagtagaggctgacatatgctgctctcattgacattgactagctgccgcaaatatacaattgtattattgcttactacatgctttatcaagaggatatcctattctggacctgtgggctggtttagagagtgaggactcatcactggggctatgggagacataagatcagcagagacagagcaaagctgatcccttgttgtcacagcaggcctctccctagtatgagccttgctttgaacatatctggaaggcttcctttagtcttgaaaatgtttacaagcctctgctcagcatctacctagccttcagacctcgcgttctcaggcctgtggtgctgtctcctctctgcttcagtatggtcttctctgtccagcttctgcatgaggccatctggggccaagggtcacaggttttagaagttcccctctccccgctccatgccatagcgacctgcaatcgcacatctggataaaacttcagccggccttctctttatgtgcctggcgcctctcttttctctgggtttttggaagtctgcctgcccagcccctcagctggggccttccccacttctgccccgccccactggttcctcccagggtaggaggcaatctctgactgtcttccgaggctctgttgcttctccttcatcaccaaatgccaggaatttgtcagatgctgtttgtaactcaaaagaaagaaagaaaaagaaaaagatacaggaaggaaggaaggcagaaaaagagaaagaaagaatgcgtgcagcagatgttgggaaagttaatttcttcattattttgcatcatccagttcggatctcagcatggggtagggaatcctctgttgtccccatctgtcgaggcaacagtgagtcccatcatggagtcccttcttttcctctctcctcccagagtgccccttcctcatcaaggtgcttctacccttaggagtgtacatttcacctataaccactgcctattttttcctagtgatatgttatgctattgatttttaattatataaactatatgcaaatgcagcctccttgtaaaaaaattaaaatattatagatataacccagcacttcttctcccagttctttccacactcccagaggtaatcatgataatcagtttgctaggtgtcttccagaacttttagcttctttctttggcttgtatatggccaccttctcactgcatcctccctgtggcctaccctctgcatgcatctggatcctaattccctcttcttataaagacacccattgtactggagtagtcatactggatgacagccatattgcattaatctcattttaacttaattacctctttaaagaccctatctccaaatacagtcaccttctgtgtactgggggttaggacttcaacatgaatttttggggggacacaattcacatttcagggcagagggaggaggctcaactgccagtgagtgggaggccaagccatgactgtacctactggaagtgtgaactgattgcaggtagggtaaggaaaccaagaaactgtctccaaactgattgaacaagtggctgactagttctcttctcccccaaatcccaaggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtggggggatgaggctcagagcaagcgaagggatcctaactctcaaaataccccaattgaacacggcatcaatcaccaacatgggatgacatggagaagatctgggcaccactccttctacaaatgagctgcgtgtagcacctggagaagaaccccacctttgttcacagaggcttcccttaaattcccaagggcaacagggaaaagatgacccagatcatgtttagagaccttcaatgtccctgccatgtacgtcgcctattcaagctgtgcttcttccctctatgcctctggccgcacgacaaggcatcgtcctgggattcaggtgagggggtacaaccacaatgttccccatctatgaaggctatgccctggccccatgcccttcatgcgcctgggactttggctgggcccgtgacctcaaggactacctcatgaagatctcccaagagaggaggctatttcctttgtgacccagctgaagagagaaattgtgcgagacacagggaagaagctgtgctaatggtggccctgggatttttgagaaatgagatgcccacagcagcttcctcttcctccctgggagaagagctatggagctgcccagatggggcagggttatcaccattggcaaatggacgctcccgtgaccctgagacccttttccaaccttactttattagcaatggagttccgctggaattcaatgacgacaaccttacaattccatccatgaaagtgtgacattgacatcccgtaaggacttatatgcccaacaatgtcctctctggtgggcaccacacatgtaccctgggcattgctggacaggattcagaaagagaatcccagccctgggcccccaggcaccattgaagatcaagatttattgctcccccagagcgggaagttacttcagtcttgggatccggggggctctatcctggcctctctctccaccttccagcagatgtggatcagcaagcctgagtatgatgaggcagggccctccattgtccacaggaagtgcttctaaagtcagaacaggttctccaaggatcccctccgagactacgtctgttaccagtcatgaaacattaaaacctacaagccttaaaaaaaaaaaaagtcgacg

SEQ ID NO: 3539 - DNA, 2063 bp, Homo sapiens
ctgctgtttgtctacttcctcctgcttccccgccgccgccgccgccatcatgagggaaatcgtgcacttgacaggccgggcagtgacaggcaaccaaatcggcgccaagttttgggaggtgatcagcggtgagcacggcatcgaccccacggacgcctaaccacggggacagcgacctgcggctggaacgcgtcacacgtggactacaatgagtccaccggcggcaagttcgtgccccgcgccatgctcgtgggatctgggagcccggcaccatggactccgtgcgctcggggcccttcggagtatacttccggccggtcagattcgtttttcggtccagagtgggtgctgggaacaactgggccaaggggcactacacagaaggcgcggagctgggtggacttcggtgcttggatgttttgagaaaggaagctgagagctgttgacttgcctgcaagggtttccagctgacccactccctgggtggggggactgggtctgggaatgggtaccctccttcatcagcaagatccgggaagagttacccagacaggatcattgaacacgtttagtgtgggttgccttcggcccaaagtgtcagacacagtgggtggaagcccttacaacgccaccctctcagtccaccagctcgtaggaaaacacagacgagaccttacttgcatttgattaacgaagctctcttacggacatttgctttcaggaacccttaaagcttgaccacgcccacctatcggtgacctgaaccacctgggtatcttgctaccatgaagtggggtcaccaccatgcctggcggcttgcccagggccagcttcaatgctgaccctgcgggaagttgggcttgtggaacatgggtcccgttttccccggctgcacttcttcatggtgcggctttgcccccactgaccaagccggggcaagccaagcaagtacccgggcgctgaccgtgccccgaagctcacccaagcaagatgttttgatgcccaagaacatgatggcctgcctgcgaagccccggcccatgggccgcttacctggacggtttgccgccgtgtttcaggggggccgcatgttccattgaaggaggttggatgagccaaatgcttaaatgtccaaaacaaaaaacagcagcctattttgttgaagtggattcccacacaaatgtgaaaaacgggctgtcttgtgacattccccaccttcgggggcttaaaaatgttccgccaactttcattggcaaacagcacggcccatcccaggagctttttcaaagccgcatctcccgaagcagtttcacgggccatgtttccggcgcaaaggccttcctgcactggtacacgggggggagtgcatggacgagatggagtttcacagaggtccgagagcaacatgaatgaccctggtgtcccgagtaccaagcagtaccaggaatgccacagcccgaggaaggagggcgagttcgaaggaggaaggcttgaaggaaggaggttggcctagagcctttcagtcacttgggggaaagcagggaatgcagtgtgaactcgtttgattcacgtcccgagccatgtccatgtggccatgtcccacgtgtgtgcaacttgctgttttccctgtccacatccatgctgtacagacaccacgcgttaaagcattttcatagtgtgtggtttcgctttgcccaattccttccagtaggccctccgggtgctgttgccgaatgtcagggcgtagttgtcctgcatggcggggatgaaccccatgtagaaggggatcaggccttggctgctgtagatgtggttgctgggccagtgtgttccaggcagcttctcgcccaggtcacagtgggggtttctaaacaggaactggctcttgtcgaattcgtccatggcttgcatgacgccgtctcggtaattcaaccccattacccaggtgaaacggggaatgaagccagcgtagcctgagatggccttgcgttggattaggttagggtggtccagctgcggcagccgctggaagctgcccacatctagcgtctcctgctggcggcg

SEQ ID NO: 3540 - DNA, 7444 bp, Homo sapiens
  misc_feature (1)...(7444): n = A,T,C or G
tttaagcatattagtcagcggaggagaagaaactaaccaggattccctcagtaacggcgagtgaacagggaagagcccagcgccgaatccccgccccgcgcggcgagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcagtttccgtaagatcttcaagttggggagcgagaagaagaagaagcagtacgaacacgtgaagagggacctgaaccccgaagacttttgggagattataggagaactgggcgacggagcctttgggaaagtgtacaaggcccagaataaagagaccagtgttttagctgctgcaaaagtgattgacactaaatctgaagaagaacttgaagattacatggtagagattgacatattagcatcttgtgatcacccaaatatagtcaagcttctagatgccttctattatgagaacaatctttggatcctcattgaattttgtgcaggtggagcagtagatgctgtgatgcttgaacttgagagaccattaactgagtcccaaatacaagtagtttgcaagcagactttagatgcattgaactacttacatgataataagatcatccacagagatctgaaggctggcaacattctctttaccttagatggagatatcaaattggcggattttggagtatcagctaaaaacacgaggacaattcaaagaaagagattcctttattggtacaccatattggatggctcctgaagtagtcatgtgtgaaacatctaaggacagaccctatgactacaaagctgatgtttggtccctgggtatcactttaatagaaaatggctgagatagaaccacctcatcatgaattaaatccaatgcgagtgctgctaaaaatagcaaaatctgagccacctacattagcacagccatccagatggtcttcaaattttaaggactttctaaagaaatgcttagaaaagaatgtggatgccaggtggactacatctcagctgctgcagcatccctttgttactgttgattccaacaaacccatccgagaattgattgcagaggcgaaggctgaagtaacagaagaagttgaagatggcaaagaggaagatgaagaggaggaaacagaaaattctctgccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgattagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggcttttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagaaacaagaagacaaaagaaaacattgaagaaaacacgcaaatttattgttgatggtgtagaagtgagtgtaacaacatcaaagatagttacagatagtgattccaaaactgaagaattgcggtttcttagacgtcaggaacttcgggaattaagatttcttcagaaagaagagcaaagagcccaacaacagctcaatagcaaactacagcaacaacgagaacaaattttccggcgctttgagcaggaaatgatgagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggaacaagagtttgttcagaaacaacagcaagaattagatggctctctgaaaaagatcatccagcagcagaaggcagagttagctaatattgagagagagtgcctgaataacaagcaacagctcatgagagctcgagaagctgcaatttgggagctcgaagaacgacacttacaagaaaaacaccagctgctcaaacagcagcttaaagatcagtatttcatgcaaagacatcagctacttaagccgccacgagaaggaaacagagcaaatgcagcgttacaatcaaagacttattgaggaattgaaaaacagacagactcaaggaaagagcaagactgcccaagcattcagcgcagtggaagccaagcactcgaatggccatgtttaagaagagtttgagaattaactcaacagccacaccagatcaggaccgtgataaaattaaacagtttgctgcacaagaagaaaagaggcagaaaaatgagagaatggctcagcatcagaaacatgagaatcaaatgcgagatcttcagttgcagtgtgaagccaatgtccgcgaactgcaatcaagctgcagaatgacaaatgccacttgttggttgagcatgagactcagaaactgaaggagttagatgaggaacatagccaagaattaaaggagtggagacagaaattgagacctaggaaaaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgccatcaccttctaggtgttttccttttttgttttttttgttttgttttgtttttaagccaaagatgaagggaaaacgaactaagacagacgttaggccatgttggcaaagtagcatcttggtgactaaggtgactttgtatattcatcttaaaaattatgttctttagacactgctacctgaatgaaaactgttggagaaataatgtttaaagttatttaagaaaaactgttacatcactaagtattaataaattcttcttacctgacgtaacttctcaatgcctaaattctgtagttgaagctctgctgcagagagttggggataattttcttttgggtgggtcagctctcataaaaaagctatgatttgctcaaatatgctgattgactcagtaaatgaatatatttttttctttaaataggaacaacctcttttaaaagagaaaaattatttcagtgatttgtcaaaacgaattacctcttttggcatgagctaataattgagggtgctaattttcttaagatagtgcctaaaacactaaatttcagtcaagtcgtaagtaggattttctttttgatcaacagggacaaaaactatctttagaattaaaaacatggttgttttggaatttttgcttctcttaccgtttgatagaaattttcatcctaaaatacatgtacaaagtttggaaagatgaaaaaaagaggtagcttttagattgcaaattggaaatgttaaaactcatgaaatttaagcaatataggtttagctatctgtgtttattttctaaaataatacctgagctggttaaatgatttctctccatcttagctaattctgtttaaaactctgtcagaggcctgcaggctgtgagttatatttataaatatatcttcagaaattaatcttaaaagaggcattagttcagaatacttttttaaaagtttaaattaaatatttaggcacgtcagaaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaagtgtactttgctgtctgagacagcacatttgtgaatgatgcttgctgcctgccattttcaacctattctctcttaagagtgctaggtaccaaattgtgaaagtttgtttgttttcagttatattacttttgaggctggtggaaaaatttaaatgtaactttgtgggaacactgattcatatttagaaaatgtaaatgtctgtagcactttcttgccagttaatttgaaaactttgggatgctgaaccttgttttgtccagtgatttagatgatttaaaaatgcatgtgtgatttgaatttttataattggttttgaccaagccataatttaccttggaccacctcgtaggtagcccttaacttctggccaagtttgtttttttatataaatatatatacatatatacatattatgtatggttgtaaattcatacacttatcacatgaatgtgttactgtatacaaaactcttaatgctttattctcaaattgctgggttggaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattgataccctgtgcgctaaatagtgtgtgggtgcctggattaatttgggtctggaatatttgattctttctgttcctttcaacttgacattccaggntttattgactcaagggagagaggctcagagtgggaatgggttgggcgctgtgggtaaggttggatctcccttaaaactgccttttggattcagtgtttgtgcttgagttcgctttcaaatatgaccataatcgtgtgggtgcaagactgtacagtgatacatatgtaggaggtaaagcattcattttaatacttaaagttattataaatctttttcaaaaagtgtttttgtttataaaatacgctgtttgtacccataccagcccacctcttctgaggccctgtattcaaataggatgatagtgatctatctttcctgcatgaagtgtagggtggccgagtggggcgaggggcgcagacttctttgaaatcgaagggtacagtcaaatctactgctgatttggttgttttgttgctgtggcagaatatgccatgaaacacatacagacttctccgaacgtgcaccctcatcagccacctcctcccctctttccctgagtgctgtgaacacagcaggacctgcacacttctgcagatccagctcctacagcttggggcactaggctgcctttcctagtcctgttcaacaaccatacagtggcggattgctggaattagctgctattctatgtgggagttcacatttaaggttttttctttatcttttttcttatgggggaaggtatagggtgggtaaggaaaaaatgttggaatgcttttactttgctgaaaatattagaactctcttgtgacaggatacagcaaattataattaaatataaattaccagaaccagagctacctctaagtcatacttcctcaaggcacaaagctctcagggcatatgaggacccaccttaatgaaggggtctctggatttcttgaggcatcagcgaggtttcaggaagtgacttatttttttgtactcttctagtttccttgtaactatacactttttcccattccacactgtggcttaaatgacaaagactcttctgagaagcccaaattctgtcccaggtattaactaggagatattggttgattaaagaaaacctagaactgaagtggaaaggaagagagttcccagttcctaatagtcttttgattaaaccaatcccttccccgagaaaatgatttttaataagaaatggggtgatccctttaaaatgcctttcccttaagttgaaggcacaacagttaatgggctgtattgttgcctaatcccgttgcctgacatgtttttgataaagctttaacattccctgctacctaattttggcggagagtgtttgcccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatg

SEQ ID NO: 3541 - DNA, 1991 bp, Homo sapiens
tgggaggtctctgcgcagcccagcccgccggtccacgccgcgcaccgctccgagggccagcgccacccgctccgcagccggcaccatgcgcgagatcgtgcacatccagggcgggccagtgcggcaaccagatcggcgccaagttttgggaggtcatcagcgatgagcattgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggcgaaagggccacttacacagagggagccgagctggtcgactcggtcctgggatgtggtgagggaaggagtaggagagctgtgactggtctccaggggcttccagctgacccactctctgggggggcggcacggggttccgggatggggcaccctgcttcatcagcaaggatccggggaagaggttcccagaccgcattcatgaaacacctttcagcgttcatgcccttcacccaaggtgttcaagacacggttgttggagcccttacaacgccaccctcttcggttccaccagctggtgaaaaaacacagatggaaacctacttgcatttgacaacgaaggccctgtattgacattttgctttccgcaccctggaagcttgaccacccccaccttacgggggaccttcaacccacctgggtgttcgggccaccattgaggcgggggttcaccacctggccttgcgttttcccggggccagctgaaacgcagacctgcgcaagtgggcggttgaacatggtgcccttccctcgcctgcacttcttcatgcccggcttcgcgcccctgaccagccggggcagccagcagtaccgggcgctcacggtgcccgaagctcacccagcagatgttcgactccaagaaaatgattgcccgccctgcgacccgcgccacggccgctaacctgacggtggctgccatcttccggggccgcatgttccatggaaggaggtgggacgaggcagatggttcaaacgttgcaggaacaaggaacaggcaggtaatttcgtgggagtgggttccccaacaacgtgaagacggccgtgtgcgacatcccgccccgcggccctgaagatgtcgggccaccttcatcggaaacagcacggccatccagggagctgttcaagcgcatctccgagcagttcacggccatgttccggcgcaaggcccttccctgcactggtaacacgggcgaggggcatggacgagatggagttccacccgaggccgagaagcaacattgaacgaccctggtgtcccaagtacccagcagtaccccaggaccccacggcccgacgaacaagggggagttcccaggaggaggagggccgaggacgaggccgtagatgccccccccaaaacgggttagggaaaacggaggaggaaagcgagggggtggggggcttccccgggacgataacctgggcagtggaaggaaaagaagcagggtcctactttaggtgtgcgctgggtctctgcgtgctcttcactgttgcctgtcactttttttttccttttttgtaatattgatgacattcaatgtaacatttgagatatttctgaattactgttgtaatggctaaaatccacataaacggtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttg

SEQ ID NO: 3542 - DNA, 3894 bp, Homo sapiens
  misc_feature (1)...(3894): n = A,T,C or G
gaattccgcggctgcactggcggcagctggaggtgtaatagtgcgggtagtgggtttggagaagttccgaggcggcaggtggcgccggttcaaggacaaggataagcgggaaaccgggccctgggcttgtcgctccaacatgcccgacaagtagaaggagcttttaccgcaattatggcatcctggcccgatgccacgggagcaagtgggcccagctaaagatgcctatcaaagtgatattggatggtgtgaaaggtggtactaaggaaaagcgatttagcagctcaatttattccgaaattctttaagcattttccagaattggctgattctgctatcaatggccacagttagaccccctgtgaggatggaagatggtatcctattccgacgtccaagcaattaaaagaacctgcccctccaatttggcccactggagaaaatccttccctcgaagtggccagataatacctaacgccaacttttgccagaccagatgacctcctgccagaattttaacccctagtgaaacaatgccccctattaagtaatatttaaaaatgggatgccaaaaagggactttaaggtgggttgttccagcccaaataccttccaaggagaggacattgttaagagaacgagcaaattaaattccctttcctacaaaacttaagactttacccagatgaagtccttaacaaaggaagtggaagagcttatactaactgaatccaaaaaggtcctagaagatgtgactggtgaagaatttgttctattgtatgaagatactctctgggttaaaaagcttaacagacagcgagttggaagacagcaacgttgtagaggttggtggctgagacaggccgacgtagaacagaccttcaatccgtcggatcctgagctgtgtggacaggctcttacagtgcactcggcaggcagtacccctcttctctaaaaatgtccattccacaaggtttgtgacatatcacctgtgagcaggttctccctaacctcggtaccttgactaccccagtggaaggtcttgatatacagttggaggtattgaaattgttggcggagatgagttcattttgtggtgacatggaaaaactagaaacaaatttaaggaaactatttgataagttattggaatacatgcccctccctccagaagaggcagaaaatggagagaatgctggtaatgaagaacccaagctacagttcagttatgtggaatgtttgttgtacagttttcaccagttgggccgaaaacttccagatttcttaacagccaaactgaatgcagaaaagctcaaagatttcaaaatcaggctgcagtactttgcacggggcctgcaagtttatatcagacaacttcgcttagctctccagggtaaaacgggtgaggccttaaaaacagaagagaacaagattaaagtcgttgcattgaaaataacaaacaatatcaatgttttaatcaaggatctcttccacattcctccttcttataagagcacagtaacactatcctggaaacctgtacaaaaggttgagattgggcaaaagagagccagtgaagatacaacttcaggttcaccacccaagaaatcttcagcaggaccaaaaagagatgccaggcagatttataaccctcccagtgggaaatatagcagcaatttgggcaactttaattatgagcagagaggagccttcaggggaagtagaggtggccgaggttggggcacacgaaggaaatcgtagtcggggaaagactctactgaaataagacatcaagcattcttcagcattgtcatgagcttaatatacttaaattctactactcattgggattgccggggatgtccctttaaacagactgctgccttcagctaaaaacttaatgttctttatacctttgtatgtatgacctacttttgtaacagaccatggttgtgtccaaggtaaaaccacagtgatatttttggatgctttgtctgcaatcttgacttgtttttgcagtatcattattcagacttcaaattgtgaatcttttaaacatcttgataatttgttgttgagagctgttcattctaaaatgtaatgaaattcagtctagttctgctgataaagatcatcaggttttgaaaggttacctgattttccccttccccccttaagttttttaccccaataatatggaagaaagagtaatgggccatccttaacattttgttttaattgtttaataaagctggctgggcgtgggtgcagcattcctacctagtgtcataaaaggcaaaatacttacataggctttcttaaaatatagggatgacattacatttttagggnggaaagtaagttgctttgcaccccctacttaattcttttccatatattgtggattacaaactttttgaatatgggaatcttactatttggaataggaaatgtgtatggtattattatacatacatacataagcatatatgtgtgtgtgtgtgtgtgtgtatatatatatatatgcatgctgtgaaacttgactacacaacataaatcactttttaaattccaggaacgggtagtctgacacggtgattatccttttgaggctgaatccgttattaacttgttatttaggtttttactcccagtagcaagggattctaagttagttgcacttacatgattattgttatttaaaactaagaataaaggctgcattttcaaagataaattggaattgctgttggtgaaataacaaccaaaatactgaatctgatgttacatacaggtttctacaggaagaaatggtataatttacaatttggagatttaataacccagggctacccagaaaaagtgacttgataacatggtaccaataagtaagggatgctctctcggtttgcttttgccactttcaagattttaacttctcaggttattaatcaaaattattgtataagttagccaatagaatttttaggttaaaacaacagatggggggtttgtggagtgtttaatgtcatgggcatttttagtagcatagaccctttgttctgcatttgaatgtttcgtatatttttgtttcacagttaatcttccctccccaagtttgctattcaaatcaactgcctgaatgacatttctagtggtttgctgttttggttttttatgttttttggttttttttgaggtttcatttcttacacaggtgttttcatcaccatcaattttacactgggggaaaaacaattcctttgtgagaatcactgcaagtatttatggcgaaaatatttttgaaagtttaggtgatacaagtgagcacaagaagttggtccagctttgggtatggagtgggtggcaataatctctaaaccattccaaaagaccattgagctgaaccctaaacttccctggggaatctgaacaaggggaatataaaattgcccatttgaaaactgacccagctaatctggacctccagagatagatcatgcccagtgggcccaaaggccaatttcaaaggacagaaattatagagactacagcctaaataaatttgaacatttaaatataattttacccactttttgtactttataagcatatttgtaaactcagaactgagcagaagtgactttactttctcaagtttgatactgagttgactgttcccttatcccctcacccttccccttccctttcctaaggcaatagtgcacaacttaggttatttttgcttccgaatttgaatgaaaaacttaatgcccatgggatttttttcttttgcaaggacaccttgtttatcatcttgtttaaatgtaaaatgtccccttatgcttttgaaataaatttcccttttgtaattttaaaaaaaaaaaaaaaaaa

SEQ ID NO: 3543 - DNA, 2290 bp, Homo sapiens
ccccatgacggggtccactctgaccttcagaacttgaggctgaagccggggcccgcggcagaggccccctggttcgtggtggtaaggtggaagcccgtctccttcaggtcgtcgtcacccagctggctgtagcccaggcctccctcagggggcctcgggctggtgccccgcttcacacgctgctgctcgctcttggcgggccacgtggggaacatggaggggtcgatggggaggggggtctcgcggaaatactcatgcttgaggccgtcctcagcgctgatcctcctcccggggaagtaggtcaggaacttgttcatgaggtcgaagccctggtctgagagcagagccccgaagcgcttgcggaggttgttgtaggggtgtctgctgaaggtcatcttcttgactgctgggagctcgctgtagccgggccagattttctcactaggggtccccagatccttgaacaccttgttgatctgatcgatttctgacttcccggggaacagaggcttctgagtcagcagctccccgaagatgcaacccactgaccacatgtccacggccgtggagtattccttggcaccaagcagcagctctggggcgcggtaccacagggtcaccacgaccggggtgtaggccttcagaggggatccgtactcccgcgccagcccgaagtcacccaccttgaggatgccggcgtggctcagcagcaggttggacgtcttgaggtcacggtgcaggatccagttgtcgtgcaggtgtttcaccccacgcagcagctggatcatcagggtcttcacctcccctggcaggaagggctgtttcatggtctccatcaggctcttgaggtcgtgctccacatagttcatcacgatgtagatcttgtccatgttgctgcccaccacaatctctctaacggtgacgatgttgggatgctgggccttgaggatggtgttgatctccctcagcgacgtgatcgggaagccctccttctccttctccatcttcagccgctttagagccacaatttcatctgttttcttgtcttttgctctgtagaccactccataggtgccctcctcgatcctgttcaggcactggaactcctcgacgctccggcagccctgcagggccggcaggtacttgggcagctcctgcttgagctcgatgggcgacagggcaggggagtcgggcacatagtcgccctctgtcagggcgctgctctgcggcgttccctcacccacttcttcctctgcttcttcactctccccggaatctcggtcgaaccgtgactctggaacaaccaagaggtggttttcattttctcgttcttcatcttcactcatttcttcctcacttacttcttcggcagactgctctgatgcctcctcagagttgctgccggtctccatctctccaaatgaggaccagtaactgagaagtagctgaggagaagcaatgccaaagtgacatgggtccttggtgatgagggagcacagagccacttgcagaaaggatttccttggagggggaaagggaaaaaatccagggttgtcatcaccactgagtatggatttcacattttaaacacattagaagctgcaggatgctgaaattgcaaggctgatggaagacttggaccggaacaaggaccaggaggtgaacttccaggagtatgtcaccttcctgggggccttggctttgatctacaactgaacgcctcaagggctgaaaataaatagggaagatggagacaccctctgggggtcctctctgagtcaaatccagtggtgggtaattgtacaattacccaaccactgggatttgactcagagagggacccccagaggggtgtctccatcttccctattttattttcaagcccttgagggctttcattgtaagatcaaaaccaaaggccccccaggaaggtgacaatactccctggaaagttcacctccctggtcccttgttcccgggtcccaaatcttcccatcaagccttgcaaattttcaagcatcctgcaagcttcgaagccaatggtgagcttccttctggatcaagctccttgtggctccctctttgctcaggggtgtggcttgtcacgcctccctgccggaggtacttgtgggaagatgggccacggagggaggccaatggccttggatccagggggggatgccatgggctgaagggctgggcttggagcaggtagggaggcggccaaaatgcgacgcgagcggttcgaggggatgggctgtgtcgcagtccgactggccttatagcggtc

SEQ ID NO: 3544 - DNA, 11048 bp, Homo sapiens
  misc_feature (1)...(11048): n = A,T,C or G
gcggccgcggagaggcacttaaaagccccgtgttaccctagaccttaaaaaaaaaaaaaaaaaaaactgcgtgtttccacccccgtcggcctgcagtggaagggcccgagcagaaccaacggggcaggggacgctgagcgcgccgtgtttctcctcccgtctgcctggagtagaacggctcgggcggaaccaacgggcagccgcgggggcgttgtgggccgcggcgcgtttccccgggctccgtggctctggggcactgaggagcggcgcccgcggggcagcgcaggagcccgatgcagggttctgcgcgtcatttccggtcccgcgggcgccccgtgaagcccacctggatccgccagcgctgtgccactccccagtgccgagctccgagctgtctccgggggcttgcggcccggccctttcaccgggcacttcttaggccccgcccgccagcgtccctttgttgtgaaggcgccggggcctagcgctatgcctgcggcggagactgcatcaggctctcgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcgtaagtattattcgtcagtgaaatctccaagtcataagacgaagaggacttcctgctcactgtaagagtcagaacaccccacaggcctgactcccttcctgtctggcttgggtggcctttacaagtaccctgtctaagctcgggagggacccgcccgtttctcagctactcccttgagcccctcagccagcctggtgtgcgtttgcgttttcatttctgggaagctgcagcaccctagtcctgtctagagagaatgaacgtcttctgggctggggtgcctgggtgttcttgctgtgagggagctgcgtgtgaactcggcctgtcccgacacggggggcccagcgtgttctgtcacccacagggccccggagctgcagttctacaccagcgccgctgcggtggccatgctcgtcccggcccgggttttctttacggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagacaccagaccagtagctgactgtgtccgccgagcccatccccgtgtaatgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcatgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttaacctgggcgccgtccttgctgaaaaagggnaaacgtccacactgaatgtttctggggcgcgtggtgtgtgtcaggcggcccaaccctgttcccacttcttccccaagggacaagtaagtacggcacactggggccaccagccagctcaactcatcctcctgtgtcacgcacccccgagggcgcaggaggcctgaggagtggctactggagccgtgtgttaggcagaggcttctgaccatgtctgagcttctttacccccaatatcgcagctggcggatttcccatgcccggtgcagcctagttgcacagaccagcctttgagacccagagctccagggcttgtcagaggcagcatggggctccagtggtacccgatctcatttaccctgcctgctctttaggcctttggcacccatggtcacttcactggttttccatttggcttctcacctgggaaatacaaaaatagccacacctgaagttaaaagtcgttcagaaacagagcaataattctgactcattaacttctacctactcaaaaaagtctgccatgatgatggaccgaagtgaggctttttaacccacaagtaacctttttatttttttgagacggtcttgctctgtcacccaggctggagtgcagtggcatgatcttggctcgctgcagcctcgacttcctgggctcaagtgatccacctcagcctcccatgtggctggaaccgcaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccctgggtttccatttctttttttctgctttcctcaaaaactaatagaagaccggctgcggtagctcaggcctctagtcccagcactttgggaggccgaggtgagcagatcacttgaggtcagcagttcgagaccagcttggccaaaatagtgaaaacccctctctactaaaaagacaaacattagccaggtgtggtggtgggcgcctataatcccagctactctggaggctgaagcagcaggattacttgaacctgggatgcagaggttgcagtgagtcaagatcgtaccactgcactccaccctgggcaacagagcaagacttggcctcaaaaaaatatatatatgtatatatgtgtgtgtgtgtgtgtatacacacacacacacacacatgtctatagctacctacaaaatatcttgctgagaatttgataggaattgcattaaatctctaggttgagttgaggagagctaacacctttgctgtgttgaagcttccagcccatgaacacattgtgcctgtcctttaccttaggtctttgatttcccttccttgggttcagagtttaagtcctgtccatatttggtgagatttttgcctacatgctgtgtgtgtgattacaaatcctgaatttccagtttcgggttctgtctactccttgacactgtgtgggaacacggtggatttttgtgcgattgaccttgctgacctcactcggttctaggaggggttttgtagagttcttgcaattttgtacctgggcaatgatgttatatgcgaatagagacaggtatacctccccctctccaatctgcctgcctttagttaccatttcttgcctagctgctctggccggaatgacctgctctgatggatgggggagtgggagtggacacccgtgtcttgcctcaggactcaagtgctctccagggagtgagatgcgggctcgattgtaagttataaagtgatgcttccctgtgggaaaaagtacatccaatatagactgtaggacaaagtctgaaagtccactgcctcccatttccacccagtcttgcctgtgagtcagagagaaacagtgctaacaggcagtgtgcacctgtccagaggctggctgtttgagggacacaggtgtgcacacctggggatgtctgagtggaaggtacaggtcaggattatgaccgtgcagtcagtcacccactggcatgatgtctgtggcatcctggggcagccatggggctctcaggccctctgcctgccccacaggccatacccctgccctggacacagctgtcctcagtgctggcctctgacccaacattgtccaggagccccaacccagaaggtgctcccgccgctgccagcctggacccgacccaggcccctcccgcctgaggccctgccaagaactgcccagcccggacacagaggaggttccgcgtggacgcagggaagagcctcccattgccccagtggaggaagctgcccaggggccaaggatgagtcacaggttcgaggaatcacatggcgaggctgtgggcggggatcttgtctgccctcctcctacataaggccccctgagcccacactgcctcagcatccctctggctccagagctcagagccacccacagccgcagccatgctgtgcctcctgctcaccctgggcgtggccctggtctgtggtgtcccggccatggacatcccccagaccaagcaggacctggagctcccaaaggtttgaggctgggggagcgggcactttactgtgggaggcctggggcgggtgggagctgcgggcaggcgggaagccaggatctcagaaacctacaggaagcacagaatggacgccatgacgtcaggaagccctcagccctgctctccatctttagggtggcctctctggtttcccagcatcctaggtgactcattatttggactttggaacactcctgagttagcacacactggtcattttaagtacaggaaatttcatagcccaggatctggtagatagcagacaaccatccaatgctcactgtacccatcccagttagactcagccccgtctgcaccgggtgcaacgagagccatggtggggtgggaccgccgtgcagcccaaggccccctcagttggcagggacctggcactccatggccatggcgaccaacaacatctccctcatggcgacactgaaggcccctctgagggtccacatcacctcactgttgcccacccccgaggacaacctggagatcgttctgcacagatggtgggtttctcatcattgagacgggctgggcgggggctcagtctcccccctcaggggtccaggactgggtgggttgggcggagctggacttagccccaggcattttctgacagccaggggcttcactgtggcccttccatgagggtggggtggaaaaccagggctccagacgttccctgtccccttggatcccctgccccaggctctgggccaacagccaaccacacagtgcagccccaggtcagactgaggagaaggtctgggcggctgcgggctgcggtgctccttggacccggggaagttcccgtggtgacctgattttaggagtgacagtgaaggcaactccaattcaagtggccactcatcctattgtcaccacctttcagggagaacaacagctgtgttgagaagaaggtccttggagagaagactgagaatccaaagaagttcaagatcaactgtgagtgtccccaggccccaagggctggctcagtgctggcatgctagccacgctctcccagaggcggctctgctggggcatgagggagtggggcctggcctgtccccactctctctgcttcagggagtcagagtgtttactccggtcaacctgatgctgaccccagaggcatcttttacctggagggcaggggaagcactaattcttggcatgacatgactggatgtgggtctgcactgtgcccaggccaaggggacaggtgctttgttgcactgttcactctggcctcacaaaaggccagggaggctgcaggcgagcaggtgggcaggtgggcaggtgggtaggtgggtaggtggatatgtatacaggtggcaggagggtaggtgaacaggtgggtaggtgggcaggtggctaggtgagtaagtggttaggtgaacaggtgggcaggtgagcaggtggttaggtgaacaggtgggcaggtggataggtgaacaggtgggcaggtgggtaggtgggtaggtatacaggtggacaggtgggtaggtggacaggtgggcaggtgagtaggcgaacaggtgggtgggtgaacaggtggccaggtgaacaagttggtaggtgggcaggtgggtaggtgggtaggtgaacaggtgggcaggtgggcaggtgggcaggtgggcaagtggctgctgttcccgtgggcctggctgcctcctgcgcactctggggctgcagctctggtcttaggctgagctcccaggcctctctgggggaagagagaggggcttacagcatgtccttggtccactgaattcttcctaacaatttgcaacattttgttctattttgttaattattatttttttaaaaagacagaggtggtcagggtctggggcctcttatcccctcatgggcacattttcccagcaaatacagtttgcttctcatgcttgggacttgcctcaggcctttctgaccctgcttgccctccccagaatcgagccactctccaaggtccatttcttctccctcctcccgcccctgtgccctgttcctgtgccatctcccgccatcctcacccgtacgtgacttctcagttggagtctctccaggtcacagcctccctgcctgccgtgtctgcctctccacggcacacctggcctctcgccctcagccggggctccatggccctccacattgcctctcctcccctttcctccctggcttccctgatcatggtccacagcaggggccacgtcccatggtgtcagtgatgaggaagccacttagtgtggtgggatgtccacacacctgcacaggactctgctgagacggaggcttcatcttccttttggttcttctcttctttccccagatacggtggcgaacgaggccacgctgctcgatactgactacgacaatttcctgtttctctgcctacaggacaccaccacccccatccagagcatgatgtgccagtacctgggtgggtctcacagcacatgagctcaacgtgggtgagaggcagcagctacgtccatggctgggaaccctggggagctgacaactggcttcctgtccacctcggtgcctgtgggctgactttttctttcttggttttttttatttgtttgttgtttgctttgtttttttgagaaagggtctcattctgtcactcaggctggagtgtagtgacgtgatctcggctcactgcaacttctgcctcccagattcaagcgattctcgtgcctcagcctccagagtagctgggattacaggcgcacgccaccatgcccagctaatttttgtattttttggtagagacggggtttcaccatgttggccaggctggtctccaactcctggatcaagtgatccacccgccttggcctcccaaaggctgggattacaggtcatccaccacgcccggccaggctgagtttttctccagcggttcatcgagtcctctgacaaagcaaggagctgatatagggccagtgggacggtcgccagtcaaggggctgggcttggtggatagattaatactcactgggcgtccagtcaaaacgccctgaaacctatgatgctgtcaaccaaacgaaggccaggaataccaaaatagccacataggcacagcccttccccatgtttctgagcacagtgtttcctctggggtcacacaggtgtcttcttgatcagcctcagccatgcttggtgagagccgggcactgggagagccaggcactgtgctctcctgtgacgctgtagacaccatcctaagctgtgcagaccccagcgctgcccagagcggagcagagggggccgggcaaggagtgggagctggggtcagggaacctggaggtgcagtggacagagccccggagaccgccctagggacctactccagaccaaactctgccagacctcggagcactggggcctccttctctgccctccctcctcaggcaaggcctctggagctccccagctctcatggaagccccaggggcccaggactgacccagcctcttccacagccagagtcctggtggaggacgatgagatcatgcagggattcatcagggctttcaggcccctgcccaggcacctatggtacttgctggacttgaaacagatggaaggtgagctctgcctaggacacgcccagcctcagctggaggagaagctgcctctttcttagcccgagccccctgctggctctgcaggactcaggtcactcctttttggcccctcccctgttctcccctggccttctggggtgcagagccaccctgaggtggggtcctgccctctcccaccatcctttcatcccttctctagccctggggctgctgtgtccccagctgtctcttctctcgctgacacctccactgtcccatctcctcccacagagccgtgccgtttctaggtgagctcctgcctggtcctgcctcctgggtaatgtatcagcctcgcccactgtctgcggctgcctctctgggcccctgggacagaccctactgtgtccagttcagggctgaccctacaggaatgaactggggtctggtcttgtgattccagaaagccaggctgctgacgtccccattcacgagcccagcctgtgtcttgcagccattgtattagtcacgggcttgtgccctatagtcagacctcatgctttcttttggggttaggggtgttggttggaaatggtgggggctataggaggaggaaggaggatggttacatggaagggcatgagaagctggggacctgcaggtctcggtcccacgttcttttttttttttctttttttaagatggagtctcgctctgtcaccaggctggagtgcagtggcacaatctcagctcactgcaacctcgacctcctgggttcaagcgattctcctgcctcaaccccccgagttgctggaaccacaggcgtgtgccaccatgcccagctaatttttgtatttttaatagaaacggggtttcaccatgttggccacgatggtctcaatctcttgacctcatgatccccccgctttagcctcccaaagtgctgggatttcagtgccacattcttaagggggtgtgctcaagcccaccacatccttccagggctcccccgaaacaccctgctcttcctccctctacttaagtgacctgtaaacccaacagctcacctcccgcctccaggaagaccaggactccccacccttccacacctccagagcagtggggacttccctcctgccctttcaaagaataaccacagctcagaagaacgaatgacgtggtcatctgtgtcgcaatcccttcctggtggacaccttggcacaagggcaatggggaaggcttgttccctgggggcaagagttctctggcagtaggttattaataaacccttgggagcatgtcctgtctggatgcgcagccactgctggggtgtgggattcagggacgagggcctggggtcggggcaggcccaggccaccgcctggcagaaccggagctcctacagacccatgggcagcttctggtggagaaaatacctcaagtttcttatctacaaaataaaagggtccactttcacaaaaaa

SEQ ID NO: 3545 - DNA, 1871 bp, Homo sapiens
  misc_feature (1)...(1871): n = A,T,C or G
agcggccgcccttttttttttttttttttaaaatggaaacatcaattttattaacaatttacggcaatagacatttacagaacaaaaataagacagttccaagacaaaggagtgtaaaagtacagcacacaggttaatactcttcaccctcatcctctcccgtcagcactatctggctccaaccttcctcataatccttctcaagggcagccatgtcctcacgggccctttgaaaactcgccttcctccatcccctcacccacggtaccagtgaacaaaggcacgcttggcatacatcaggtcaaacttgtgggtccagggcgagcccaggcctcggaaacaagttgtgggtattgctcagcatgcacacagctctctggtaccttgggccagggtctccgccagggaaccacagtggggaggctgggtaattaatggccaaccttgaaggccagtggggcaccaattccacaaactgggatgggtacgttgggttttgatgggtggcaatggcagcaattgacatctttggggaaccacgtcaccacggtattaacaggcaagcaagccattgtatttacccatgggcgaggggtcacatttcacccctctgggttgggctggctcaaagccaagcattgggtgatctctgctacagtaaagctgttcgttgtaggctttctcagcagagatgaacaggggcatatgtgggccggagggaagttgaatgccggggtaagggaaccaggttggtctggaatttctgtcaagtaaccattcaggggctcaatccaatttcagggaagcagtattggaaggacacaacctggttaataaggcgggttaaggttaagttagttttggcgctccgaaatcgaggtttttacgaaaaatgtcactaaatggcctcattgtctaccatgaaggcacaatcagagtgctccagggtggtgtgggtggtgaggatggagttgtagggctcaactacagctgtcggaaacctggggtgcccgggtaaatggagaactccagcttggatttcttgccattaatcaactgagagacgttccaatgagcagggaggtgaaccccagaacccagttcccccaaccaaagctgtggaaaaccaaagaagcccttgaagaccggtgcaactggtcaagccaagcttgcgaatttcggtcccaaccacaaaggtcaaatgaatcttcctttgcccaatgggtgtaagtcccctcggggcaataagttacttggcaggcattctttcctttgccctgtgaatgaagcttgctcaagggttggaaagagcttggcggtaaagttgcccaagtgcggaactttcattcaaatgacttgtggggttcccaaagtcttacgaaacgacgtgcccgggggcaccggtgcttgccaagcaccccgtttcaactgaaaaaaggtgtttgaaaggaaatcatctccctcccccccaatggtcttgtcactctggcatcatggccatccgggctggatgcctgtgttccaagctagtggtcctcccaggcaggcattgccaatctggacaccatgcctggccaacgtggatggagatagcacacacgcatagttggctagggattaggaggcgaaggcgacaggagcagaccaccgggtcccggttaccgtccaccgacaagctaagagtcgagggaccacaggggtgaaggaagctgccttgtacccacatcttcncgcagaggctgacccgcggctgattgagtccctctcccagatgctgtccatgggcttctctgatgaaggcggctggctcaccaggctcctgcagaccaagaactatgacatcggagcggctctggacaccatccagtatt

SEQ ID NO: 3546 - DNA, 2764 bp, Homo sapiens
tttttttttttttttttttttttttttttttttttttttttttttggcaaattaccaacccatttttatgggggaatatcccaaccttcaatcaatcctctaaaaaatattattctgcgtgcctttaacaaatctgacaaaaaaacaagtttccagtttacttgcattggaactatgagcgattttaactaaacaatcaattaacatatatttaaaaccattaggtacaggtaacaatgaaacacttcagtgctttaatctgatggcatcctaccactatgcacatggtcatgtaacactactagtaattaccctgaagcacaggcaaatgtagatggaggactctccctaaagagcaagtttaaggggagtaaatatcatcgtcatcatcatcgctactgagaataaagctgctgccagtggataggggcccttcttcaacactcccaaaaccacccaaagtccccctctcatcagaatcgtcaaacaacttctcactggaatcttcctcctcatcaaacaacttctccattggaatccatcaatcttcgaacaacttttcgtcagcatcttcaacttcctttcccatctgcatcttcatcttccttgtcatctgactcttcaaacagcttttcatctgcatcaccttcttccgcctttttatcagcagcttcaaggccccttttcatctgcatattcttcatcctctttctcatcagactcatcatcaaatactttttcatatgtatcctcctcttcttccttttcatctgaatcttcggtcaaactctctctcagagccttcctcatctaacactttttcagagccggtcatcttcaaattcggagttttcagagtcattttcttctaactctttgtcaagaacattttcatgaagctccttttcagaaccttcctcgtccaaatctttctcgagaccattttcttcaaattctctttcggagccatcttcagactgtttttcagagcagtcttcatcagactctttctctgagtcatcttcttcggactcttttgtggggccaacctcctcttcagactccttgttgaggtcatcttcagattcctttgcaaggccattctcttcacaatcatttttgagtgtcttctttttagactcttttttaaggactatcctcttcagatcctcttaacgggattgccttcttcagactctttttgggagcagctgccttcaaaccctcttttggggcagccctcttcagattctttttcagggcagccttcttcagcctctttttcggggctactttccttagcattgttttcagaagcaccttcttcaaattctcccccatcttctgtcttttcaaacttcttctcatctataggttcttcaaacgccattccagttgcagtttcttgagcattcattttagatgtgctggggtgctctgaaaaatgccttgctctagaaggccctgccctttcggaagcagagacagaatctgaacgcctaaggcctctgttggcctcaggagcattgaggaaagcctcccatcctctcagcctttcctccctttctcttgaggtttcctccacctgataatctgtagtcccatcccatgcctgggcagtgatttgacggccaccaaaccatcttccatcgagagtctgaatacaataatcagcttcctctggatcccgaaaggacacagaggccacaccatctgggtgcctatcaaagagaaggagtttcctaatttgtccaaacttcgaacactctactcgaaggtcttctctgatctcattcagcaccaacggatcatcctcaaaatccataggatgaaacatattcttgatgatgacaactcgctcatggcgcatccgggatggtccggctcgcctctcaggtctccaatccaactgcttttgttgcatagacagcttcttcttatagtctttgcacttcttcttcttctttgaggcatcatattctcccttcagttgaaactttgccacctcaacatgtaatttgtagcctctaatttcatcttcatccaaaagttttaatgcaagttccacagattctcttttcaaataacagcaaagaccgtctcctttaagatttccttgattatctttgtaaagtttgaccttaaattcttctgtctgaggatctctcataataatgccaaacttggacataagttgtataaattcatccactgtaatatctggaggcaaaccagacacgtatacatttgtatttctgtcttcttcaagcatgaaaccatcctgactcagcctttcttttttctcccttctttctggcatcagtgggttccggggctttttctttgtggaggttcctctgcagtcctagcatggacatcttcaacatttgcggtagaactagatgctccatcgttagagaagccataattggcctgatatgtagcaatgaaatcttcacgaaatctaggcgaaccaagcctttttgtccaggttcccactcgtagggagttgtccgtcgcttctccccgagagaatcgggttctccgccggcatcggtctgggtgtcaccatccttgccgtctccgtacaattgcttgcattcgcaactgctcatcaaactcatcgttcccatccaagttggtgccgctcatgtttcctacctagctcaggagcagggttcagaagaactaagaggccgaaatgacgctggagctggcttgctccgccgggcctcggcaccgccgctaggtccagggcgctgcg

SEQ ID NO: 3547 - DNA, 4636 bp, Homo sapiens
gagatggagactcgctctgtcacccaggctggagtgcaatggtgagatctcggctcactgcaacctccacctcctgggttcaggcgattctcctgcctcccaatcctagtagctgggagtatcaggtgagtcgcagccccaacgcacgcccggcataatttttttatttttagtcgagacgggtttcaccacgttggccaggatggtctcgaactcctgacctcaggtgatccacccgcctcggcctcccaaagcactgggattacaggcgtgagccaccgcgcccggcctccatatccattcttgggaacacttgttgcttagctgaacggagcccgcatcctgctgtggcggcactcgccccggtgctggtctgagcagacgcctcctttctcttgcagaagaagtaagtgaggaagaaatgagtgaagatgaagaacgagaaaatgaaaaccacctcttggttgttccagagtcacggttcgaccgagattccggggagagtgaagaagcagaggaagaagtgggtgagggaacgccgcagagcagcgccctgacagagggcgactatgtgcccgactcccctgccctgtcgcccatcgagctcaagcaggagctgcccaagtacctgccggccctgcagggctgccggagcgtcgaggagttccagtgcctgaacaggatcgaggagggcacctatggagtggtctacagagcaaaagacaagaaaacagatgaaattgtggctctaaagcggctgaagatggagaaggagaaggagggcttcccgatcacgtcgctgagggagatcaacaccatcctcaaggcccagcatcccaacatcgtcaccgttagagagattgtggtgggcagcaacatggacaagatctacatcgtgatgaactatgtggagcacgacctcaagagcctgatggagaccatgaaacagcccttcctgccaggggaggtgaagaccctgatgatccagctgctgcgtggggtgaaacacctgcacgacaactggatcctgcaccgtgacctcaagacgtccaacctgctgctgagccacgccggcatcctcaaggtgggtgacttcgggctggcgcgggagtacggatcccctctgaaggcctacaccccggtcgtggtgaccctgtggtaccgcgccccagagctgctgcttggtgccaaggaatactccacggccgtggacatgtggtcagtggggttgcatcttcggggaagctgctgactcagagccctctgttccccgggaattcggaaatcgatcagatcaacaaagtgttcaaggagctggggacccccagtgagaaaatctggcccggctacagcgagctcccagtagtcaagaagatgaccttcagcagacacccctaacaacaaccctccgcaagcgctccggggctctgcctctcagagcaggggcttcgacctcatagaaccagtttcctgaacttacttcccgcggagggagaaattacccttaggacgcgcctcaagcattagtatttcccccgaagccccccttccgcatggaccgcttctttttccccacgttgcccccccaaagcccaacaccagcctttttaaccggggcaccaaccctaggcccccctgaggatggcttgggctacaagccagctggttgacgacgacctgaaggagacgggcgttccaccttaccaccacgaaccaggggggcctctgccgcgggccccggcgcttcagcctcagagttgctgaagtgtcagagctggaccccgtcatagggaggaactcagccggagaccacaggcgtggctatctgccggcttggaactgcgatgggactcggaactcctcgtcttactttgtgctccatgttttgtttttgtatttttggtttgtaaattaagtagaattaaatcattttccttgtaaacccgaattcgggaccatcacagtttgattagcctcagcctcaagagctggcacatgcttgtgaacttgtgctttcatattttcctaacctgtgtgctctttgtgggaggaataacccagactaggaatgccagcatctgccaagcagttgggataattcttcactattccacccttgccacagtactatgggtaggagtgacagctcgaaatatctacaaacaaggtcactaaaaaagctaaaagatgcccaggattcctgatgaaccaccaccttcaaccaagaccaatggctcagattttaccctgatttggtgggtgggtatcccccatcattggttttgcgggcataacttgcagcagcgaacattaaagaattacggcagtcggccaaaccgcacccctattgcctggatggcatgggaaccctccttgggaggccttctatgggccagccagcttcatcacttttgtaaactgcatgtactttctgagcatatttattcagttgaaaagacaccctgagcgcaaatatgagcttaaggagcccacggaggagcaacagagattggcatgccaatgaaaatggcgaaataaatcatcaggaattcaatgtctttgtctctgatttctacatcagccttggaaaatgagcacacttttcattctcagctcttgggggccaggccatactttgctcttatatgttgcactgtggatgtttggggctttggctgtttctttgtattaccctttggacttggtttttagcttcgtttttggagccacaagtttaagcttcagtgcgttcttcgtgatgcaccatgtgtgttaacagggaggatgcatagacttgcagtggatcatgacttgcatgcccaggaccggagctcggtattcagtgcaaggtcaacgtcccagcccccccaacttcttaatgggacggaatggaggggccaccccaaatgccccaaatagcagtgcggaagtcttccatgcaccaaacaaaaagtgctttcaagcttcaaaaaattcctcccagggctgtcaaattaacaaactttgcaggcgggctgcagctcagtggccatgccaattcttttaccttttgaactccacccctgcagcttgataattagttttgacagaacatttcaatgggacaatgatatttaaatggcacgttggcgccttttggaagtttcagttttcgaacaaatgtgcactcaagcccgcaccattaaaaacagaagtaaaggacacccgggcaagccgactcacagtcctgagagaatatgcctacgatgtcccaacgagctgtggaaggaagcgtgcagaacggcttacctaaaagccgggctgggcaataacgaaggacactgagggaagcggaagagctaatttagcctacagagagagacagtcaaccccccccaggcaagacagcagcgatgctttgtagcacaccttcccaaaaagtagcagaatttttgaaaaagccagttccaaccactagtaaaaaagatgcgttaagggaagcccagctgtggttgaacttggaaaatccggccaaaaatctttatggcctcaacttggcccattccagaatggacccaattaaaaagccaatggggcagggagggtcccttgctcgggacccgaaaccactggcaatgttaaggctcggattatggaaacacgaaacttactgtgtaaacattggctgggcttccctaggcagaaattcaaatataaactgtgattacagaggaaaccacccttcaactggaaggatatcattaaacagaggataagagatcaggcttgggatgatgtagtacgtaaagaaaaacctaaagaggatgcatatgaatataaaaagcgtttaaccttagaccatgagaagagtaaattgagccttgctgaaatttatgaacaggagtacatcaaactcaaccagcaaaaaacagcagaagaagaaaatccagaacatgtagaaattcagaagatgatggattccctcttctttaaaattggatgccctctccaaacttccactttatcccttaaaccggcctggtaccagaggttaaagttgtgtccaaatctggccagccataacatggaagggaagtagccccagtgagtgttagtgatgcagctctcctgggccccagaggagatcaaggagaaaaataaagctggagatataaaaacagctgctgaaaaaacagctacagacaagaaaccgagagcgagggaaaaaggaaatattcaaaagcgtatgaaaataaaagagaaggagaagcgggagaaaaactgcttgaaaagagcagtgtagatcaagcagggaaataccagcaaaaccagtagccttcggagaagttaaaaccagctgaccaaaactgggcaaagcttccttcataaaggataaaggtaaagacaaggccttaaagttcctctcaagcattcttttctaaattacaagatccaagtaaaaatgcaaatcaatgatgcaaagaaaacgagaaaagaaaaagaagaaaagacaggatatttctgttcaataaattaaagctgtaatatattctgaatataatgtaaatattaatgtgtaagcttatattgtgtcattgttctgttttataataaaattcttgagaaccttaaaaaaaaaaaaaaaaaaaaaaaaaaa

SEQ ID NO: 3548 - DNA, 4188 bp, Homo sapiens
ttttttttttttttttttttttttttttttttttttttttttttttaaaggagtgaatgtgtttattctcttagtgtgtaattgaatacataacaagtcacataatcaaatgattcattaccttcacacacaggaaggaaaaacagtagctaggtatttctgttatacaactggttgtgaaaccgggaggaacaaaaatcctttatagccattagatggttgcaggaaattctccaaagtttgggcatgtccgaaaaagaactttgactgcatcttttttccatataaaagggatttttttcttacatttctgtgtcattaggaaaaatctggataatcttataaggattttttcctgctcttctttacatttaggaggaaaatgggtttaatggatatggtactatttaaaaaatcaggaatcccaggataactctggtggtggaaatccttaccattgtctagcagataaggttttcagatgcctgggaaaaatttaaacaacatataatttacatcttcaaaatttaacatcccagatgggatgttttaatcctttgtcactaaatggttactaacgctgtttgagtggtcataaatgaattgtcatttgtattcaatagtaatagcaaaatttacctgccctataaagtcggcaaaaacagttgtataatagtttacatttacaattaatgtacccatacctcaaaacacatttagaatttaaaaaaactggcttggaaaaaaatcacaaaaaatttaagtgacaacaaatcttgattaactagtccatcttcctaccacacatgattatactctaatgtagatattctggttgaatttcttccaacccaagtttgaaagggccccaatataaaatcaagtgttaatactttcagatttttattgtcccaaaaactggttgacaaagaaaagcctaacttcaaacataacttgtttcctggctatacaaagacctatttcaggtgctacagatactgaaaataggagtattttacttatttctcaagagacagacttatgccatctaagaaaatgaattcagtttttaaatgatttatagtaaggaaaaacaggaaaacaattccaaacgaaggattgactctgataggcttacaacaaaaatattcagtttactattttaaaaactaaattgagtaaagtatttgtgatttagactataaaataaattctcaaggaattcaacccctccagtcaatactttttcttaatgtctgcattgtaatttagccattttgccatgtgggagtacacaaatggaattggaatattgggatccagaatttacccctaacttgaagagtaaaaagttatccaaagtttcacccttacatggctttattgaaataacattcccatcgaaaattcccaataaaaattggaatatattatgagcactgcccaattgcctcattttgtctgatattaacagattatgcatttcctcagagaagcagtaggtccccatatatacagacatatatatggcttcttggtttggaaagagaagacaattttgtatagtattatgatttatcactgtgctatcaatcaaaaaaaccaagtaagaaatacaattaaaacaacattgaaagggaaaaatttttaaatctcacatcttcaaggaatattttctacagcatatcatttgaaaaagtagaatgaatactgttcatggtccacatgtattaaacaaaaaacatgtcaattacttggtgcaaacacacagaacctggtacctgttttttttttttttttaaccaccattgtctacaccttttttaaaaattaagtttgttactaaaagtccaatgtcattcacttgtatttatggatcatcaaatggtaattagggcaacatatgtaaatgcatgcctctgaatcagaattcatgcagtgttaattatcctgaataatttatgacattctcccagggtatttggaatgggtatctttgggagggcttactcaaatggaacccacaatacctccactattacaggcttatagggaaattacaatccactttacagggcctcaaagggttcattctgtgggcccaaagccccatgggaggggggaaggggatctaaagggtgcttcatggtcaaggttatttttactttgtttttttactggtcctaccccaatggtaaaatggaatttttcttcacagccttttactttaggggcttaaaataggacagtttttcttgtatttgactttaacctttagagggggacagtcgtcccctgggaaaaagaagtagatttactgtccctaaccattaaattccccagtctttccaaataatgtgcggggcggggggtgcctgggtgtgacagggtgccagtgaataagatgccctatgtacaagacagtggaatagttcacctcaaaggtttacaagataacatttgtaagacttgagtgacagaggcaaaattttagcagtttctcaagactcttggagttgagcagatttgagaagggaaatcaggaatcgccggagccttgccatctgtccagtgggttttgggtctgtcccccaagatggttccccaatccatgtgccttccctgttggaacaatcctaacaaaatacccatacgggggtagagaaatctcctgcaacactgacttttgggtcagtgaatcagagtcctaaattatttcaggcttcaaacagatgaattctgatgcattacttagtctgagaccaaactcaacatacaagcaagcacaacttcctagatttctgcttccatttcgcctaaaattacaggctttgtatatgaagtcaattttacttctcaaaaaatgttagtctaataaaagacctgaaatctatttcccaactaaaaaaaaattagtggattaaaaatacaggtaccttgactttaagtagacagttaatcaacatatgattagtaatacaactaatactcaagaaaaaagtataatacagcaaactcagttttacaattatgtattttttcctaacccaattcctcgataaggatgtaagaaactcatcaaaacatgttgctttagtatataaaccagctgatgcaaattactggggtaatataggaaattttatagcatttagtaaatgaatttaaaaaaactaaatgattcatgtaaaatgtttatatatggtatatacagcttggatgcacatcgagtctaagaataaaactgtcgatttgtaacatctgtatggacatagtaagatacagtacgagattcatttttaaaaacaaggaaaaatagcactaatttaaacactcgaaaacagctcttacaaaatccttaaaaacgtacatcagagaaagatgctgaaaacaaaacaaaataggcttctctgtcatcacagaatatccaaaggacacctcacagcatggagcatgacgaggtttatttcccttcacttatggtttacataggatatgcattgggaatttattccatgtaagagtaaaggcataaggcaaccaggtctccttctgtttctgttgcatttacctattattggaccattttattgctcacgctcacttttaagtacttatttgccttcatttaaaaatattccattttacagctatctacagataggcagcccttggtgctgagttctctgcagctcgtcatttgaaaggattccacttaacttccaaacaaactgccatgaaagtggcattttccaggttttccaggtttgccccagaagtcaacgtttgctgggcttggagaaaataaggatttttaataagtgatcttaggtctaaagtaaccaaaatgaaacttcttttgcgcaatagattccaaaatcaggatttataatcaacaagaaaataaaagttcaaaaactaaaaccctactgggtaactctttggttagattatatataagcattaacaactctaagtttaggactcaaaacagtaagttaagtaaactgccaggtaagagtaggtctgttattaatctttataaaatacttggcatgtttgcatttactatatgatattttttaaatgtgcatatactcaaacagatggtacaaatttccaactttcaaatcataaatgactatgtctgcttctcccttcccacccttcctaccctttccctcgtgc

SEQ ID NO: 3549 - DNA, 15274 bp, Homo sapiens
  misc_feature (1)...(15274): n = A,T,C or G
tctagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttcttttttgtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtggaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgccacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccagcagggtaggcttgttttgatttctctctctgtagctttagcattttgagaaagcaacttacctttctggctagtgtctgtatcctagcagggagatgaggattgctgttctccatgggggtatgtgtgtgtctcctttttctttcaggacttgtaggattctttgtgccatttgcatataatttggcaggttcacattttttaagagccctatgaagtgctttttgcatgtgttttaaaaaggcatttgaaaattgaaagtgtgatttatggaaattaaatcatctgtaaaaaattgctttggaaagtaatgattgctggccataaagggaaatatctgcgatgcacctaatgtgtttttaaccctttatttgctgacaatctatagtcattaatgctaaactcgattttggcttcagctacatttgcatattgtccaacaatggtctatttttgtaagaattagataaaatgtatacttgatataaaatagtcaaaaatgtaactcttagtaacagtaagcttggcatttagatagaccatgaaccacttcgtcagatactctgttgggtgtttgggatagcaattaaaacaaagtattgatagttgtatcagagtctattaggctgcagcaaaggaagtttattcaaaagtataaactatccaagattatagacgcatgatatacttcacctattttttgtctccttaatatgtatatatatatatatatatatatatatatatatatatatatatatacacatatatgtgtgtgtgtatgtgcgtgtgcatgtttaacttttaattcagttaaaaacttttttctatttgtttttcatctggatatttgattctgcatatcctagcccaagtgaaccgagaagatcgagttgtaggactaaaggatagacatgcagaaatgcattttaaaaatctgttagctggaccagaccgacaatgtaacataattgccaaagctttggttcgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatgagaattcctaatgggaccaagtacagtactgtggtccaacataaacacacaagtcaggctgagagaatctcagaaggttgtggaagggtctatctactttgggagcattttgcagaggaagaaactgaggtcctggcaggttgcattctcctgatggcaaaatgcagctcttcctatatgtataccctgaatctccgcccccttcccctcagatgccccctgtcagttcccccagctgctaaatatagctgtctgtggctggctgcgtatgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtaaagttcagggaagctgctctttgggatcgctccaaatcgagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactcgtgcagtggtttgccagaatgggagccttaattgcctttttccaaggggcctcaacccaatctaatggggagtctggtcctgtgagggctgcaagggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgcctttgggggtgccctgggatccctggggtagtccagctcttattcatttcccagcgtggccctggttggaagaagcagctgtcaagttgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccggttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttttgtatacttttcaagctaccttgtcatgtatacagtcatttatgcctaaagcctggtgattattcatttaaatgaagatccccaatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaaatttctaggactagacgatgtaatacccagctaaagccaaacaattatacagtgggaagggttttacattattccatcccatgtgtttcctattccatgttaaggtactactacatttgaagtgggcagagaacatcagatgattgaaatgttcgcccaggggtctccagcaactttggaaatctctttgtatttttacttgaagtgccactaatggacagcagatattttctgccagatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccaaggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaataaagtcatacagtagctcaaaaggcaaccataattctctttggtgcaagtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcatttttttgcatccaattgtgcctgaacttttaaaatatgtaaatgctgccatgttccaaacccatcgtcagtgtgtgtgtttagagctgtgcaccctagaaacaacatacttgtcccatgagcaggtgcctgagacacagacccctttgcattcacagagaggtcattggttatagagacttgaattaataagtgacattatgccagtttctgttctctcacaggtgataaacaatgctttttgtgcactaccatactcttcagtgtagagctcttgttttatgggaaaaggctcaaatgccaaatttgtgtttgatggattaatatgcccttttgccgatgcatactattactgatgtgactcggttttgtcgcagctttgctttgtttaatgaaacacacttggtaaacctcttttgcactttgaaaaagaatccagcgggatgctcgaggcacctgtaaacaattttctcaacctatttgattttcaaataaagaattacaactaaagacaacgagtttgttttttgtaagctccacttcttgctagcagttcaccactgatcctctaaaatcaaggtggttaaacgatctgtcacacacagtgagtctgaatgctaaagcctctcctcacctcactccctctgcccaacacccccaggtgtatcaggaagtgtgtggacactgtggtcaggcagaactggcctcaattcttggcttcaccacttacaaattttatgatcattggcagttgatttttcagagtttcgggcttccttatcaacaatatgatgataagtaataacacctaattcacacgatggtggtgaggactaactgaggtgcctcattaaacatagttgctgttttttaatgcctggcccaaatccttccctgtgagggagaagaaggatgcttgagagtggttatttatgaatgaatgagtgaatggaagaatgagtgatctgaaatgatataattagcttaaaaacctctccctcattctgaaggtaaagcaggaacaattggtccacccccaccccaggtttccatttcaggactcccttccctttttggagctacctgcgtgcttcctttacccattttctcagatttaactgatgaattgggagggggtgggtataggacttactgagatgcaacataatattcacacaggctctgcagctagattactgtttgaatcttcattctacctttttttttttttttttttttgcatcaccttgggcaagttgagttccctgggcctcagtttcttgacttgtaaagagagatgacagtgcatctgccctggaagggttcttttatgaagaccacatggttcgctcatggagagtatggaaggaccgtggctgacactgcttctccctctccagagtcttccgaaactgcacgttggactcatttctttattaggatgggttgagggtcttctcattgtttgagtcacatggatttcaggaaactaattcattttcttgtccaagcattcccttggcaagttcttcaatccctgttttcaatggtttcctcatttctaaaatagaaacaagaatagcacttaccctatagcagtactgtgaagattacaagactggacatgtgaagtgcccaggatagtaccacacatagtcagcactcaatccacattagctatttttgtcacaattattgttgccctgtctgagcatctacatttaatagaatgatggatatgtttagatttacatttttcacgttattatcgttttgtacatgcctcctgtctttgttcctctgttcttactgcctttcgttgttttagtgatattatggtacaataagaaatatatatttggtctctggccccagtttctgagacaatttctaaaactcttgtagacaggggtgctaggaggctcttttgttctaatatttgtctttgaccctggtttctaacacagagctccaaatcccttggaatttcctgggcaatagaaacttcttttgttctaatgaggcagctcctggtgggctcctggataacctcaggatggggaatcagccatggcattaaagggttggaactttcagactctaccctttgacctctggagaggctcttgagaggctctggagaggggctgatggttgaatagatcatcagtggccactgatgtaattaatcatgtctatgtaatgaagctgccataaaaaaccccaggaggacagtgttgagagagcttctaggttggtgaacacttgggggtgtctggaagacagcccacctggagaggacacggaggctcttcgcaccttcccccatacctggctctctccatctcttcatttgtccatctgtatctttttcattatattatccttgataataaactggtaaatataagtgtttccctaagttctatgagccaccatagcaaatgaatcaagcccaaggaggggtttgtggaaactccaatttataaccagttggtcagaggtataggtgacaacttagtactttgcaattggtgtctgagatggggggcagtcttgtgggactgagcccttaacctgtgggatctaacagaaaacctttaagcttttccccccaaattgttaaataaatatttttagggtgtcattttaattcctctgttaattttttttttttttttgagatggagttttgttctgtcacccaggctggagtgcagtggcacaatcttggctcactgcaacctctgcctcctgggtcaagcgattctcctgcctcagcctcccgagtagctgggattacaggcgagcgccaccacacctggttaatttttatatttttagtagagacagtgtttcaccatattgggaaggctggtcttgaactcctgacctcaagtgatccgccctgcctcagcctcccaaattgctcagattacaggtgtgagccactgggcccagccaatttaattattttttgaattattttcttagtgattgctcagtatgcatctttttttttttttttttttttttttgagacggagtctcgctctgtcgcccaggctggagtgctggagtgcagtggcacaatctcggctcactgcaagctccacctcccgggttcacgccattctcctgcctcagcctcccaagtagctgggattacaggcgcccgccaccatgtctggctaattttttgtatttttttttttagtagagacggggtttcaccttgttagccaggatggtctcgatctcctgacctcatgatccacccggcctcggcctcccaaagtgctgggattacagggcgtgagccaccgcgcccagcccctacttcttgtttttcaatgttgtatccagtgaccttgctaaatttgcttattctaacagttggcccctagcatcttgattttctaggtatattgtgttgtctgtgtgtaatgtcagtttttaaatttcttctttcctaatcgttatgccttttgtttctttttcttgcctcattatacttggaatagaagtagtattagcaggcattttggtcttgttcttgaaggtaaccattttggtttccattgtgtggtcccgtcacatttgtttcattctgcaggtgctttttggttccttctcagcaggtagtgccccagcagcagggctcactacaaccctggactcctcaggactcctgggtctgtgagccatacttggttgagcaggctgaacacaccagtatccatcctgtctcaccctcaagtcctcatctaggacatcattcctcttgtcatggtgggtggagccagttcaagtgggaggacaggaggcaggtgtggttggaggaagcagcctgaacctgcctccctgacattccacaggtgaacccagatactggctacatcaactatgaccagctggaggagaaccgcacgcctcttccaccccgaagcttgatcatccgcaggaaccaagctgctactccccgaaacctgggaatatgcccggctacggaaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaaggaaaggagtgaaaaagtgtgggatncccaagacttggcaaagagattctgtacaacctggagtctcttatcaattctgctgtgttccctggcctgcagggaggtccccacaaccacgccattgctggggttgctgtggcacttgaagcaagctatgactctggaatttaaagttttatcaacaccaggttggtggccaactgcaggggctctgtctgaggccctgacgaagctgggctacaaaatagtcacaggtggttctgacaaccatttgatccttgtggatctccgttccaaaggcacagatggtggaagggctgagaaagtgctagaagcttgttctattgcctgcaacaagaacaccctgtccaggtgacagaaagcgctctgcggcccagtggactgcggctggggaccccaggcactgacgtcccgtggacttttggaaaaagacttccaaaaagtagcccactttatttcacagaggggatagagctgaccctgcagatccagagcgacactggtgtcagagccacccctgaaagagttcaaggagagactggcaggggataagtaccaggcggccgtgcaggctctccgggaggaggttgaagcacgttcgcctctctcttccctctgcctggcctgcctgactttctaaaggagcggcctcattgtggacccacctggcgccacggaggatgctggctggccggcggacccccacctggagagatggatgagctcgtccaaaggggaactgttgacactcgggccctttgagggggtttcttttggacttttttcatgttttcttcacaaatcaaaatttgtttaagtctcattgttagtaattctgggacaggttattaaaggatttaaatttgaaccgggggttttcccaaactgggacaaattagaggaaaataaaaaactaatgtcgccacttggtcataatcatttagatggtggtgtagggcaaagctgtaagaaagattgtagcgttttactctccctgggctttccctcccgccttgctgcaaccagggaggaattgccccatgtccacaggcttgtacacactgcccccctcactatctggttatcccagtggccatgcccaaaggagaactgaattagcttcctggggcctcctgcctgtaaatccagaagtgtatggttagtccaagagtaaaccaagatggcacccccagtatggtggggagggtttttgctgttcagtagcctcaaagtattgggtgtagaaatggccctccctcccctcccatccccgggaagtccccagtccccatccctggtgtgagaatcaacccaaggctttcctggctccaccttgagataacccaactccctcccgtgaatcaggaggcccaaattgtcaccttccccaaagaaatttatattttcacggtagcctgaaggtgcaaacacatagatcgactcatttttaaataaggcacatatcacaattttttaaccacaggaatgtctaccagaattatagctttaaaaaatacaaccaatttttatatttcaaaaatatttgaactcaaataaattaatttcttaaaaagtacacttctcatactatgtgtttggcattgactctgggttaactcttgtgcagcaacacctacggaggatgctatcacacacggcgccagtggcaactcctggcaccagccgctgcaacggactggcacctcacgtgggtgggcggggactcacattcacaagaccgggacggggaacatgcagtaataaaatagcttttttaaaaaataaccccatataaattcatcacatagggattatgcttttcactggcaaccttgaaggtgggctttatccgcaatctgtgactccagcctatttagtggcagacaatcccgggtgaggcagcctgtggtcccaccttgtaggtggcagcccctgcaatct

SEQ ID NO: 3550 - DNA, 8778 bp, Homo sapiens
  misc_feature (1)...(8778): n = A,T,C or G
ggtgtgcgcgctgcgcccgcgagctcccgggctcggcaaccgtggcatgcttaggattggccatatttaaaagttctgaagtagaacctgcgcctcctctctgcttctccctcctcctcagtaatttatttcgagcttccaggcaagggccacggaagaagggaaagcaagaaactagatgcctgtgtggtaactcctcgcggagctaaggtggactctcttgcagccaacttcccatcagatcaccttgctggacttgcagaccggaatggggctcgcctaaggagccgagcgctgcggaggctgctgcgtgttggatgggagtgggagggggctggagcgagatttccagggcgcagtcctccggggcgttacgccgggcataatggaattgcagaggacgtctagtatctccgggccgctgtcgccggcgtacacggggcaggtgccttacaactacaaccagctggaaggcagattcaagcagctgcaagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctggctaaacccaccaagggacgaatgcgcatccactgcttaaagaatgttgacaaggcccttcagttcctgaaggagcagagagtccatcttgagaacatgggggtccccatgacatcgtggatggaaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcattttaatctggcagatcagcacctcggccctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactaatggcaaacactttactggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctgggatgctggacatcctcaagattgtctccagcagcgacgtggggccacgatgagtattccacacagtctcttggtcaagaaacacaaggacgttgccggaagagattcgccaatttacaggcccacccttttnacaccgctgcacggaacaagccagcgccctttcccccagggagcattgccgagtcttccagacgttgagggggcaggcttttcgggcttcgagggagccgttttaaggaggtggcaagaactgaacgcggctgcggaagcaggcactcccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccaccccaggacctgggcaatgacctggctggcgtcatggccctgcagcgcaagctgaccggcatggagcgggactttgttggcccattgagggcaaagcttgagttgaccttgcagaaggagccggagaaagctggattccgagcaccccgacccagccccaggccatcctgctctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaatgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaaatggcttcacgccctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagtttgacggaaaagaggaaaggaaatgatcgacaagtgggaagaccgatgggaatggttaagactgattctggaggtccaatcagttctcaagagacgccagtgttgcccgaggcctggctgcttggacaggagccctacctatccagccgagagataggccagagcgtggacgaggtggagaagctcatcaagcgccacgaggcatttgaaaagtctgcagcaacctgggatgagaggttctctgccctggaaagggctgactacattggagttactggaagttgcgcagacagcaagaggaagaggagaggaagaggccggccgccttctcccgagccgagcacgaaggtttcagaggaaaaacgagtcccagcagcagtgggatacttcaaaagggggacccaaggtttccccaaaccgttttgcccagcttgaaccagggattcttccacggatggcagaaacggtggacacatggcgaaatggtcaacggcgctacagaacaaaggacggagctctaaagagtccagccccatcccctccccgacctctgatcagtaaagccaagactgccctcccagcccagagtgccgccaccttaccagccagaacccaggagacaccttcggcccagatgggaanggcttcctcaaatcgggaaacacgagtggggaggcccacgaataagaaatgcctcaagcaggtcctgggcacaatgtttattgtgtcataaataaccaagaaattgggtttctacaaagatgccaaagactgctgcttctggaattccctaccacagcgaggtccctgtgatgtttgaaagaagctgtctgcgaagtggcccttgattacaaaaagaagaaacacgtattcaagctaggactaaactgatggcaatgagtacctcttccaagccaaagacgatgaggaaatgaacacatggatccagggctatctcttccgccatctcctctggataaacacgaggtgtctagccagcaccgcagagcgacgccagcattacagcctgcgctgcagaccactccccaccagtcgtcgtcacgcatcaccatgcgagtccaagtcccggcaagcgggaaaaggacaaagagaaagacaaagagaagcggttcagccttttttggcaaaaagaaatgaactcttttccttcacctccctgcccttctctttaccttttcagtggaaattccaggcatggcaaggcttcaggaacccaacacatttactcttcttgtggccttaatgtttccttcaatgtggttgatttattttttttttttaatttatagagcatttcgggggggcgtgggggaaacacacctaaacactttatctccaagttacaaaagtttgaggttgcgagggaagggccagatttttttttttaatggaaattatataggattaggatcttcagtatttaaacttgttcctcaattttgtgagggctgtgttgggaaataacccgcctctaggtgctgttgggtatgcaagggcagcgggtgcttaaatcaataatttcctgtgctcaccagaggcaaaaatgtacccaatatccctgacacccattctctctccatttacttctgggtgggttacccctggactcttgactcttaggaagtgccccgaggatgggggcttaaccttttatttaaacagatccgcatattatggatccttggctgccagccacagtggcagctccacattaactcctacagaccaaaccatttgtatctgggcttcacttacttaacacaccgacatgcgggcttttctggcatccaactggctatgacggttaagaaatgtcagtatacaagaaggaatagaaaactgatactggtttaaaataatctggtaatttcaatttttttttttttttttgctgaaataccattatattggtaccgtttgaagataaattcctagtacaaaagtataaataaaactaggatgtataaataaacccctttaaaatcaattgggtaaagtggtaacaaagtgggtgggaactgaagcaatttactgggggcaaaggtaatggttactctaatggggtacttggctcgtggcgttgcccacactgtgttattaattttgcttccatttccttgctatttggatacatagtggtgccatttcccctggtccactggtaactattgtaatgacaaattttcatcgntactgcaccaatccaaatgacattgaataggaatgaactccaggaggctgggcctggaacagggaaggtggtcgctccaggccctgggtgctccagtccgtacgacctgtacctcttcaactttttgccctatctgttaaatatatggcttatgtccatttaaatgcttttaaatctaaaaaaagaataaaaaaacg

SEQ ID NO: 3551 - DNA, 7918 bp, Homo sapiens
tttttttttttttttttttttttttttttttttttgcttttcaaatcaggctgctttattctgttgtggcaggagttcccgggcccctgggtgccacctctgccccactcccatcctctccccaagctcccatttctccagggtttgtccctgcggtgtgggcagaagcagcttcttgcccgtctgcaaaagctgcaaaagaccctttgcccggggcgtttcctttcccgttggggcttccactgaccctgtgaagcaaaggaatgttgaggatggacagagagaattcaggggagtgggaagtaccggtctgtgagcttcccctcccccgagttgcctgggatgaccccgcttcaagtggacgcccccaacgccctggttcaagcgagcgctcctccacaagcccgggcaggtggcccgagcgctcctccgctgctgatcaggggccctgggatcacacctgctcaccggaggcgtcctagatgtagtagagcggcacctcgccacacagggtgctcacggccatgcccaggaaggccgggtcccctccggagggtgctgagcctgcatctcgcccctctgcctggcccagcttagacgtaggcactgcgggcttggcctgcagagagcattccatctggaatgtaggaagtgagtttctatcccatgtgcagcccttattgtgggacttcaggtatatcaggcaatctctctgagcctcagttttctcatcagtaaagaggggctgtgctagagtcagaagccaccaggtagtgagtggactcagctgagcccagcagcttggcagtggggtgggaaggaaaggagtcgtgcaggggaataggagaggggcagtcagctggcagccaatgaggaacagtgctttacaggtgacaaatagccaccattcggacactcctcccagcagccctgggagggagacagcccactcttttcacccacacacacacacctggaagttgtggacttttctagtgagagcctcaagactggggatgctctctggagctatcttcatgatgtagcagcaggtgccaggggctggcttgtaggcgatcagcagctaggcacagaatgctggagatcattcggggtcctgccctgctctctccctgacccaggtccttagccacctccctctaggttgggcacgggagtcatactagaatctggggctcagcaaaaagtctggaggagaggagagatggatgtggatgaagtggcccagctgggtggctctagcagagcccagttgtcattggtccaggtcaggaggtctggcatacccacctgctggtagtcatacaccacgaggccagtggagccgatggagaaggtggcagtggtaaccaggtgctcactcagggccaggcgttgctgggcttccggcgccccaatgctcatctccagaacctggggaaaggcatggagccacctggtcttcccctttcctactcagccagtggtacccatccccatactcaggcctctgtactcaaatgcgcttccctctttcccaagagttcagggaggctgagtggaaccaggtgctggagggagctggctgtcctgtcgcgggcaggggccttgtggaaaagcctgagctgggttgctgcctggttcgtgcctctttccttctagctgtgccccttgcctcctcccctccactccccttggacagtttcctatcgcccatcccacctagcccctctgtctggcatgtcctgtgcccactgctgtgcatcccacacctctcaccatctcctgtgtgtttctggctcatgtggagaccccatgagcagggctcccacgaatcaccacgacgatgaggaccaccaccaccaccacgaataagaaagcgtttcaggtgcactgggcagcaagggatggcccaatcggcccccggggagctgcggagtagtcctgacacggtggggcaggcaaggagacaggcatgaggtcatgaggctgtcccctcttctccctatacaagctgaacaccctcccacggctgcctagggctggacagccgatgcgatggatggacagggaagggctgaggagatcagagaaggcttcttggaggaggtggcctggattctaacaaacccatagatacatatagatacatagaagcttagaagcagggtctagttttgagggacccaagagagcctgcttcacctgtctctccctgctgccttccccagccatggtcagcccctctctctccccaagtgatcacctccatgcggtgatacagagtctccctccttcctggaatgccttcctccttctccaccgggcgagctcctccttattctggctccagctcgtatgtggtttttctctgagaagtgtcccctgacttctgaagtttctcatggcttctgactcagggctgtctacgcgcacagccctttctacggacccctatagtggctcttggcccacaaacagctccccaagggtccctggcttagtggtcttggtgtccccatcctgacttatcacagtcctaggttagttgagtgaatggatctggataaggaaacaggccagggaggatagaggaggcagggcccatcacacacatgtgcgcgcgcacatacatacacacacgcaaccacactcaccggcgggctctccatcaggacctctttgctgcccacatccatcttgctgcaggtgctatgctctcctctcctcctctcccaggtgtgaccagggtcttatatgtgtccgtagggagaggggacagaggtgaaggaccaagccccctgtgtgccagccaagcccttggctttgaagcctgtttgttcctggccctccagaaccgaagcccagataagccccctgtgagagcccccaagggcccttggccctggcacatgagtcctcttggccccagcaagagcaaacctgggtgagttgagcaaacttgccctcgggccatctgcacttctcaccatgggtgtcttcctggcgtgcctgccttccttgctggcacctgcccctgctgccctgtggctttcctttttcttctaccaccctgaacctttcaggtggccaagggtctgaccatcatatttcccagcagaatttctagatacatagggatgcgctccaggaagagggttctggaggcagcacctgtagactctgagaggactctgcccaaggcaggaggtgctttgacatcagttttcggggtttcataaatgtgcatttccctgcaaggaccagttccaacttcaagtactctttcccttaccttgcctcctcccacatatctggtaccaacctcaaacttgcccccagtgattattttcctaattctggaaactctgtccccactggtggcaagctcttactcatgtgcagtgcttccttctttgctctgggcttgtctgtcaattgcaggctgtgctgatggcagattccaggtctgacactgctttcttctgcccggacagccctgaacagggctggctctggtcactggtgggctcccagtctccccatcctcgaatcagctcactcaccctgtggtctacactctacccctctagactcccctttctgcatcctctgatcctaaatttgccctgagaataatactcacccaaatacgatcagctttgaggactgtctccttctcttttctctgtctttcctagtgccttcccaaagccatctctatgtatttacgaggtcaaatctgccaatgactttgggctggctcaccctttctctcaggttccctttcactccttgggccaggtggtctctaaagtcccttcacctctaaactcaggtgactgtggcagagtccaggcctgggctcgctcccttaacctcctatccttttgttttgttttgttttgttttgttgtgagacagggtctcactttatcacccaggctggcatgcagtagcgagatcactgctcactgaagccttgaactcctgggctcaagtgatcttcccacttcagcctcccaagtagctaggacccacaggcacagcccacccatgcttggctaatttttaaaaaattattttgtagaagacgggatgttgcccatcttgcctaggctggtcttgaactcctgagttttccgtttctttgtagtatcctgtttttcatcttaaatacacctcaaatctctctggagatggaattaaaattaagttattctttccacattgtcctttggtttccccctccaagaagtttggtccataattttcaaaggccccctaaatcctaacctccgtgaacttttccttaatccctccttcccctcccccatcgccccatgtcctgccgaaatttcctaactcacccattccccatttaagaatcaacataactgttaacttgtataacagttggcatgggtttcctctgctgttgtacagttaggtctgtttcttcaggaaacctcttctatacctgaaggcaacaggcacttgagtaggaggtctcagctgtcagtagagaattagctgaccggctgggggtaggggcacttatttccactagaagagaaatttttttctggagcaccaactcttatctctctgcaagcagcctgttcaattcctttatacaaacaacaacagcaacaataacaagaaatttttaactggtatcaatagtggagactgcctgtgttctgtgcataagagttgggggagagtaggagagggctcaatcttaacaaactggagtaatccttcaagtaagacaagcttttcaggtgcgcaagtctctttggggttaatgttgttcagatcagcttacattttaatctgaaagggttcttcactctttcattatcatgcttcatccactttctatcttccagaaatatgcttgagatccttctccacttataaccaaatcccttcagttttctttgctgagatgtgtcagttcctttttgcatttcttgacttcaatttcagtggggcctgccacctcgatgggcactccttacatctgtgtgaggaggtacaatttcataatattttccttccattcaggcagataggccaggctggtagccacttccttctggatgggccaggcccaggcctcaaagaacggagccaggttcttctgcacttggtgggagaacatcttgacccacagattcattttgtcaacattttctgtgggcaagttggtctggttcctgtactcggtgaagagacggatgaatggctcccaaccaaaggcttcctggagctgtaaatacgtttccagtgcggtccatgcattccagtttttcacattgggacccttgctcaggtagattctgactctcttctcccgaactgggggccacagagcaatattggcacggcttcgaggaatgcccaagaccgtctcatgcacatacacacaccacaggttgcaggtggcctcggtggtgtgtggtgggaactcccactcctgccgctgctggttgcggcccagctcatggacggggccccacagccccttggttctgatgagcttctcgttgatgagctcctgcactgactccaagatggcaacatgatggggtaccctgcatgcatccagcccactgagatctgcacgtcggcaacaatcctctgaggcaggcgcaaagggaagggctcagctcccagtcgcgccacagcctgcatcacctcatcccagaggcggagcagcggctcagggttctccagagtacgaagatttgcggtcggcacggtcagaatgatgttgtccgtggccagctctccccagggccctggattctcctggatacgcctcttccactcctccagggtggtctcccccagcttgtagtatggagcatgcacagcccccttcacggtgacaggcacagaacccagtttgctgttctgaggcacaattatatagaggagtccaccccagaggcacgtgatcgattttgtgggtttgtccaagcagcaccggttaattacgagtgggcctcggaaaagcttgctggccctggtcaggtcatctgtgtggcagccaatctgtatcttcaggtcggcagaggcagcagcttcaggcagtgagacttctataatttgccttccaggtatgtagagcccagtactcatccagcaatatctggtgcctggattggtgcagttgacctcgacggtgataggagattctgaggggcgcagataggggctgctgtacatatcttcaatttctgggactaacagagagaggtcgcttccagagtgggccagccctgtggccagggaaagcatagcacctctgcagcagtcattgataacagggttctctcgggttgctactggaagccgatatcgacttagcagcttcctcaggagtcgatgcacagacatgtaggcagggatctcttctgcgggaatctgcaggaaagctgcaccatctggtcccagctttgccaaccagcccttttccacatttcctctcttcctgcccattataacctggaactcggccaaggtggagcggaagtgataggtccttatccctgctttaggagtacgaaagggccctggattgaggctttggcttgtaatgctgatgccaaaggggttgaggaggaggtttcctgggaatcgagccaaaggggacactccggggttcttgaaggcccaccaccaggcttgggctccaacaaatagcccgccaccctctgctacaaactcctgcagttccttgacccccacttcactcacgggttcaaagcagtagacacttgcatcactggtcagattgggctcgatgctggtgtctatgccccccactgcgaggaggccactcagggttctcagctctgtctgcaccacaatcttgcctctgcggcccccatccagccagcggacagcattgagcagaaaggggcccagtttaccaacagtgaataataccttatggccagtcacaaccacccggccccggccatagcgggcagccgctataacacagccatggtaggaatctaaccctagaggaaaggctaaagccccatgcactagcagctgggatgggaaacaatccgagttgctgatgtccagctctgaaatcccatgcagaagctcttctctgtcgtcggagaggtcatcttcacaactaaccaacactgggatcttgggcatcttcttggagactttaaagaaactcgtgtcccctttgttgtcagtaaagtaaatgccagccacactggtcacgaggttcccagggaacgtgaacagaaccctttcatcctccccctggttggcccaatcccaggcttgtcctcctatgagcaagccgccaccacatttcatgaacttgaccagcttttctgtcatggtttcattgtaggcatcaatacagtaaacccccagggagtctttcacttctggctcaacctttgcatccactccagagccctcgaggattttggccaaaggtgccagggatgggtgtacaccaatgggagccccaggggaagagcaaagccaccccactgcgttcaggagaaagggcgtgagctgggcttccaccaagtagtcctcatgggacacgaccaccaggcggccacggccataggaggaggcagcaatgaggacctggcccatgtcattcaccatcacaggaaatgaagcctctccaataagaagcagttcacatggaacagcatcttcgggtacatcccagcttgtcacaccattcataagggcctcgaaggcagcagagggagtcgccatggctctattggtttccggggcccaggcctcggtcaccgcgggcctctcctggtccagagtctacgctgaaccccactcactgtttgccccgctgttccctgcagcgcgggttcggggcagtagcaacctgcta

SEQ ID NO: 3552 - DNA, 10992 bp, Homo sapiens
  misc_feature (1)...(10992): n = A,T,C or G
cgactccgctcgccacgtggccgcgttcccctcccctccgccgagctccagcgcctggagtgcgctcgcccgttcggccctgcgcctcgtccgggtccccgggaagctgctaaggaggggccgtcgggtgggtggacgtccgtctcgggtctgggttccccgccgcaccgcgaggaaaaccggggatgcgctgcgatgaccggcagtaaccccggccggggcgcccgcggccggggtcaacgccgcacttgcgccgcggccgcgaggcatccgggaccgcccggcgccgaccatcaccctatagctattaaccacccgtgtgcgcattgggccggtgcgaacacccctggcgccgattggttgtgtgccgccgcgccgcgcaacgccgcgccctcagccagctccgcgcgggcagcgacggcggcgtggagtcggcggccgaagtgcgggcacgcgggtccgtccgtccttcgcgcgatgtgggtccgagcgccccgccgcagccggctggacccccggtgtggcccacggggtagtccccagtgtggcccaagtattcccatcccgcacacgtggccccggcggacacgggggtcggggatggctcgggaggcgcgccgcgggctcggtcgcagcccgtgcgcgtcggggccgcggggcgggaggcggaagtcggggggcggtggtttcccgcccgccccgcccccggcgctcctcagtcccagccccacccccccagggcgttcccgcgcagggtcccggctcgggcggcggcgcgcacgagcatcaccccaccggcggcggcgcgccgggtcccggggcgcagccccgacgctcattggcctgggcggcgcagccaagctgtcagcccatgtggcgtggccgcccggggatggccgcggtttaaatagcgtcggcgccggcctagagggagccagagagacggcagcggccccggcctccctctccgccgcgcttcagcctcccgtccgccgcgctccagcctcgctctccgccgcccgcaccgccgcccgcgccctcaccaggtacgagcagcggcgctggggccggcgcgcgggtcgtggtcgggctgggcccggggccccgcggagtaggtgggcggatggcgggggaaggactccggggaaatccaccaacagccgccttcgcttcccagtttgggaggccgcggaccctgaagggcctggaggagcccccggctcggcctccccgcgcccacaaaagcgccgccgctatcctcctccccggagcccgccccggagccgaggcccagcccgaaggggacgccgggagggaggaacgggggggcgcaggggccgcgccgggaccggcctccccatcacgtggcgcagcccggccgaagcgcaggggtcccgagcagcccccgcccggggcgaaggaaggccgggccgccgcggtgttcccaccccctgcctggccgtcgaccccgcgtgaatagcaagcggcgaggacccagcgtgcgggcctggagctggcccggggcagccaagcctctgtgaatcgcagcgggtgggaaggcggccgctccctgccgggaccgccaagggaggccgcactgccgaggggcggcgcgcgtatcaggccctggggcctcgtgcaagtggccagaccagcagctgcctccgccccctccccccagggccgtcaaccagccctcatgctggaggaggagccggcggcctgggcacgttccgggtcttagggacctgggctccagggagggcctcctgtggtgtgtgggttggtatggggaggcaagcgtctgtgggttcacccgcgcaggtgaagggtgccaggcaacacctgcgtgtcctggccaggagtggttctccaggttggaccctgctggaggggttggactggctgggtcggtccacagtggggcaggggccacctttcccccagagtataggctatccccatttcgtccctccccagccctggtggctcttgggctggcctgacagcgggcccccaccccaacacgggtgagactgggtgctgagtacccccctctaggctcccagccacctccatgccccggctttgggaccctgcctctccatttctttgatggcccttagcaggctggcaacctgaggccttgtccccatctcaggtgaccctgcctgctcctcactgtgagccccctggtgccctagggatgtctgggacaagctccaggagccttggaaggctgagactcaggcgagtggaagccgacacaggcgcagaaaccagtaactgctggggaggccagggctgcagggctccagtgggtaccccagccaataccctgaactgaatgggtcaggcccagaggcgggcctgttcccagagcacgcagcccctcccagcgagagcggggtcagggcccaggaactggccacatgaggaagggagccgcaggagccagggcccgcacggaccctcagggtggtgcttggcccatgggtgtccacctgttctgggtgccgaggctgttgacgggggtgtcgtggccgggatgtgtggggcactcacaccgcccgccctgcagagcagccatggaggaggtggtgattgccggcatgtccgggaagctgccagagtcggagaacttgcaggagttctgggacaacctcatcggcggtgtggacatggtcacggacgatgacctgcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccgggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaagggagggtgtgtttgccaaggaggtgcggaccggcggtatggccttccactcctacttcatgggaggccatcgcacccccactgctgcaggagcttcaagaaggtgattcccgggagccgaagccacgttcagcccgctggctcagcacctctatccccgaggcccagtggcaanagcagcctggcacgcacgtcttccgccgagtacaatgtcaacaacctggtgagccctgtgctgttcccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcacgaggagcagcaggtgcccatcctggagaagttttgcttcactccccacacggaggaggggtgcctgtctgagcacgctgccctcgaggaggagctgcaactgtgcaaggggctggtcgaggcactcgagaccaaggtgacccagcaggggctgaagatggtggtgccggactggacggggcccagatccccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgcggacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggcgccacgctcttcctgctgccgccggcccaccccgcaggacaagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaaccgtccggtgtgtgctgctctccaacctcagcagcacctcccacgtcccggaggtggacccgggctccgcagaactgcagaaggtgttgcagggagacctggtgatgaacgtctaccgcgacggggcctggggggttttccgccacttcctgctggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttcggtacgcacggtcgcttcctggaaattggcaaattcgacctttctcagaaccacccgctcggcatggctatcttcctgaagaacgtgacattccacggggtcctactggatgcgttcttcaacgagagcagtgctcgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggacngtcgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgtttgacttcttcgctccgggatccggaacagggctaccaggccaaagcaggtccgccggtggaggcgccaggggctacaggtgcaggtgtccaccagcaacatcagctcactggagggggcccggggcctcattgccgaggcggcgcagcttgggcccgtggggggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcgggcaccgtgggcattttggtggagacgatgagcaccaacgacacgatcgtcagtggcacgctgcccacgcgcattggcgtccttggcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctgggcggctcactggcggacctgggcctggactcgctcatgagcgcgccggtgcgccagacgctggagcgtgagctcaacctggtgctgtccgtgcgcgaggtgcggcaactcacgctccggaaactgcaggagctgtcctcaaaggcggatgaagccagcgagctggcatgccccacgcccaaggaggatggtctggcccagcagcagactcagctgaacctgcgctccctgcttggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctacttacatcgactgcatcaggcaggttgcagcccgagggcccttaccgcgtggccggctacttcttacggggcctgcgtggctttttgaaatgtgctcccagtttgcagggcccagcaggaggccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctttgaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagaacgggtggccgctacggcgaggacctgggcgcggactacaacctctcccaggtatgcgacgggaaagtatccgtccatatcatcgagggtgaccaccgcacgctgctggagggcagcggcctgggagtccatcatcagcatcatccacagctccctgggttgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagacgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccaattttccccgatgttcccttgcgggacgcgggcagccacccatagcctgctggctgcggccccctttcggccaaagcatttggctcagccccgctgagtggggggtcgtgggccagtccccgaggaactggggcccctgcacaggcacacagggcccggccacaacccagcggcccccctgcacagcccacccgtggggtgcttgcccgttatgcgccggcgccggggactcaactccatgtttgggtgtttgtctgtgtttgtttttcaagaaatgattcaaattgctgcttggattttgaaatttactgtaactgtcagtgtacacgtctgggaccccgttttcatttttacaccaatttgggtaaaaaatgctgctctcagcctcccacaattaaaccgcatgtgatctccaaaaaaaaaaaaaaaaaaaaaaaa

SEQ ID NO: 3553 - DNA, 3119 bp, Homo sapiens
  misc_feature (1)...(3119): n = A,T,C or G
gggcacgaggccagctcgccgctcgctatggcgtcgctcaccggtgaaggcctaccttctgggcaaggaggacgcgggcgcgcgagattcgccgcttcagcttatgctgcagcactgagcctgaggcgcaagccgaggctgcggcggcgtccgggaccctgcgagcggctgctgagccgggctggccgccctgttccccgcgctgcggcctgtgcggcttccagggcgcactaccgcgatgaggacggggacttggttgccttttccagtgacgaggaattgacaattggcaatgtcctacgtgaaagatgacatcttccgaatctacattaaagagaaaaaagagtgccggcgggaccaccgcccacccgtgtgctcaggaggcgccccgcaagcatggtgcagccccaatgtgatctgcgatggctgcaatgggcctgtggtaggaacccgctacaagtggcagcgtctgcccagactacgacttttgtagcgtctgcgaagggaaagggcttgcaccgggggcacaccaagctcgcattccccaagccccttcgggcacctgttctgagggcttcttcggcacagccgctggcttccggaaggtgaaacaccggacactttcgggttggccagggttggggaaatgggttccaccagggaaactgggagcccacgttccttcctcgtgcaggggaaggcccgccctggcccccacggcagnattcagttcttggtccatcggaggatccgagtgtgaatttcctgaagaaccgttggggagagtgtggcaagctgcctttagccctctgggccattgaaattgaatatcgaatgtggaaacacggagggaaaagaagccgccctgacccccgtttcttccagaggtttccggccacgggggagaagagcagctcacagccaagcagctgcttgcttcttgatcccagcaagccgggtggggaatgttgaagggcgccacgcagtcttcttgggcggagcaggattgaggaaagattcgctttgggagttccgagggggcgccttgaggaacagatgggagttcggattaactgtttcagggagggagatgatgactgggacccatctgtcttcaaaagaaagttgaccccgtctacaggtgaactccagtcccctacagaatgccagaatccgaagggccaaagctcttttgggacccttcccagggagggaacccacagggcttgaaaggaagctgcctttgtacccacatcttcccgccagaggttgaacccgcggcttgatttgagtcccttttcccagattgcttgttccatggggctttcttcttgattgaagggcggcttgggttcaaccagggttcctggcagaaccaaggaattattggacattcggagcggctctgggacaccatccaagtattcaaaagcatcccccggccgttgttgaccactttttgcccaccttcttcttgcggtgcccctcttcttgtcttcatagttgtgttaaagcttgcgtaagaattggcaggtctcctgtaacggggccagttttctctggccttctttccagggttcaggggttaggggttgcaagaagccattttaggggcaggcaaaacaagtggacatgaaggggaggggtccttgttgttgttgtgtgtggttgatgtttcctggggtgccctgggttcctttgcagcaagggttgggcctgacgagaccccaaggcttcaattgcagcgcgctcctaagacccctcccctgcagggggctaacgtttagcagccccagcacattagctttgcctaaatggcttttcactttcttcttttgttttaaatgactcatagggtccctggacatttaagttgattattttcctgcttacagacctgggtacactctggattttaggataaagtaaagcctagggtgttgtcaagcaggcagggctgggggaaggccagttgtttgtggggctttcctgcttggggactgaagaagggctcaacgaagggcaatccgcaaatgttgggtttcactgagaagctggcctcctgggtctcttcaccactgtaagttctctcattttccaaaccatcaggctgcttttaaaaataagatctctttgtagccattcctgttaaaatttgttaaacaatctaattaaatggcattagcactttaaccaatgacgtttgcatagagagaaatgattgacagtaagtttattgttaatggttcttacagagtatctttaaaagtgccttaggggaaccctgttccctcctaacaagtgtatctcgattaataacctgccagtcccagatcacacatcatcatcgaagtcttccccagttataaagaggtcacatagtcgtgtgggtcgagggattctgtgcctccagggaccagggggcccaccctctggcccaggggagtcctttgcgtcccatggaggtttttcccgcaaggccttttcaggacccagatgtggacggggtgttgtnggcccgagggaagttgggacagcggcagtgggcctgctgtaggctttctcttgaggcctgtgctctgggggtcccttgcttagcctgtgctggaccagcatggcctggggtcccctctgaagagaccttggctgcctcaactgtccacatgtgaaactttttcctaggtggccaggacaaaatcgcgccccatttaagaggatgtggctgtaacctgcctggatgggactcccatagctccttccccaggacccctcagctccccggcaactgcagtctgcagagttctccctggaggcaggggctgctgccgttgtttcaccttccatgtcaggccagcctgtccctgaaagagaagatggccatgccctccatttgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcataaaaaaaaaaaaaaaaaaaaaagttttggtcgaccggccgaaaatttagtagtagtaggcggccgc

SEQ ID NO: 3554 - DNA, 5360 bp, Homo sapiens
  misc_feature (1)...(5360): n = A,T,C or G
atgaggctttgtctccctaccgcgccgcgggccgattctcccgcctcccagccccggcgcaccgcgccccgcccagcctcctttcctcgccgccctccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcaatgtggcaaccagatcggtgccaaggtaagaattttacacctcttttatttctttttacaaggaaaaatccaggtaagttatgaaaaaatggttgtggggcatttgcacccgctatccttaatcaagatttccccctctcaagtttgttacatttatatatataacaattgtagctagcatttccctttggaaagctgggaatcatttttcttcgcaggcacattttggagaaactagtaaaagggctcttcgggtttgggggcggggaagaccgaggacttataagatgttacttaaaagggcttctaacggtccaaaaccgggcagggagagagatgcggaaacggtcgcagacaaagcggggccaggttttgcccatgtgcatcccgcccaaccctgcggggtacttagggccaaaccggagcgggaaggggtgaggccatcgggcgctgcagagagctccagcgcaagggtggggggccgatgcgcagggtgggctgcgctgggcgtacctttcacaaaagaccagggaccccaacgcgcccggaccccagaggccggtcctgtatttgttcctggatggaaggagaataagaacgggatttaattttccattgctttcatggcccctaagagagacttttttagggcgttgaacaggattactgtcgagaaaatgggggtgtgtggttttctttaatgagtccctcaggacttaatgggagagaaagaatcctttaaatcaagggtagaaatgtagcgaaggaataaaaattccgaggccaagggggattttttttttttgcgcgcggttacaggtgtagcggagggaggggcgggaggaagtgcggctgctacgttgtagcagaagggcggggctgcgggcgcgcgacgaggcgacgtcgatgggcggggtacaaatgcggcggttgccgccggcagggcgcgctaccttgggccccgcctcgcgcgaggaagtttttgtccctggccccgccacgcgcgaagtcttttgtcggcggctgacctgcgcgtccgcagtcacctggagggcggggggggtggtcgactgcgcggccagctctttcctcagacccccagccttttgtgcgccgcgggtggggcggtgccagcttgggggaaggagagcggcgttatcgaagtgtggtcgacctccatccgcccaccgagcattgggacccgctgcacatatccagagcagggaaagctgtggctttctcgggggagcgagtgtctaggggaagggtgtggcaggcccagggatccctccaggtacaggggttcgagaccatcctgggcaacaaagcgagacccctcccccatggcattttctacaaaaaataaaagtaaaaaattagctgggcgtggtggcgcgcgttctgtggtcccagctactcgagaggctgagatgggaggatcggttgagcctgggagttccacgctgtagtcatccggtggactgcaggctgggcccaggaagacctgtcttaaaaattagaagaagctgggctgggcgtggtggctcatgcctgtaatcccagcactttgggaggccgaggcgggccgattgcttgaggtcaagtgtttgagaccagcctggccaacatggtgaaaccccgtctctactaaaaataacaaaaagttagcctgggcgtgttgtgcgcgcctattgcccagctactccgggggcctgaggcaggagaatcgctgacccgggaagcagaggttgcagtgagccgagatagcgccactgcactccagcctggtgacagagcgagactccgtctcaaaaaaaattaagaaaaaagatgaaataaaatggtagttggggccatagttggctgggacttgacctgttgtggtctcgttgctccccctcggccagttctgggaggtgatcagtgatgaacatggcatcgaccccaccggcacctaccacggggacagcgacctgcagctggaccgcatctctgtgtactacaatgaagccacaggtaagggcaggaggcgcagctcaggttcccttccctgtctcccacttatctgggatctctttccatttctgggcagcgcttatcccctttggtgaatctttcatttttgtcccctttcgtgaacccacgtcggggcccaaagcaggttctgctgccaccgggtcgggaccctggaatgacaagtctctgatccctgctgtctcccatttccagtatatctataaaccttcccttctgccagatttcacacctcttaactttattctctgtaggtggcaaatatgttcctcgtgccatcctggtggatctagaacctgggaccatggactctgttcgctcaggtccttttggccagatctttagaccagacaactttgtatttggtgttatacagatgatattagcagatgatatacgatctgttcaacttatttggggcaaggacacaggaaaagttaggagatgagtgttgtattggaatgctaatacagaaatatgttctgaaatctaacggagggtagaggtaatgcctactattgctggtaaattatggggcagtagggggagaatatatcacagtgaaggacaaaaggagatacatccgagggaattatttgaaaagttgaaagatggaaacatcatgtatcttccataccctgttaattagcttttctcctgactggcattccaggtcagtttgggggcaggtaacaattggggccaaggccacttacacaagagggcgccgagctggttgattctgtcctgggatgtggtacggaaggaggcagagaagctgtgactgcctgcagggctttccagctgacccactcactggggcgggggcacaggcctcntggaatggggcactctcctttatcagcaaggattcgagaaagaataccctgattcgcatcatggaatacctttcagtgtggtgccttcacccaaaagtgtctgacaccgtggtcgaaccctacaatgccaccctctccgtccatcagttggtaagagaatacttgatgagacctattgcattgacaacgaggccctctatgataatctgcttccgcactctgaagctgaccacaccatacctacggggatctgaaccaccttgtctcagccaccatgagtggtgtcaccacctgtcctccgtttccctggccagctcaatgctgtacctccgcaagttggtcagtcaacatggtccccgtcccacggtctccatttctttatgtcctggtctttgcccctctccaccaacccgtggaaagccagcagtatcgagctctcacagtgccggaactcaccccagcaggttttttgatgccaagaacatgagtgcttgcctgtgacccccgccacgggccgataccttcaacgggggctgttgttcttcgttggtcgggatgtcccatgaaggaggtcgaatgagcagatgcttaacgtgcagaaccaagaacaagcagcttactttgtgggaatgggatccccaaccaatgtcaaagacagccgtctgtgaaaatcccaacctcgtggccctcaagatgggcagtcacctttcattgggcaattagcacagcccatcccagggagctctttcaagcgcatcttcgggagcagtttcactgccattgtttccgcccggaaggcttttccttccactggttacacagggcgaggggcatgggacggagatgggagtttcaaccgagggctggagagcaaccatgaacggaccttcgtctctggagtaatcagccagtacccagggatggccaccgcaggaaggaggaggaaggatttcgggtgaaggaggcccgaaagaggaggccttaaggcaggagcccccaatcaactcaaggcttctcaattcccttaagccgtcttactcaactggcccccttttcctctcccttcagaaatttgtgttttgcttgcctcttattctttgtttttttgtttttttcttcttgggggggggtctagaattccagaacagtgccctgggcaaataagtaggccgctcaataaatacttggtttgttgaaatgtctccctctctctttcccactctggggaaaccctaggtttcctgcccattcctgggtgacccctgtatttcctttctggtgccccattcccatttgtcccagttaataacttcctcttaaaaatctccaagaagccgggttctccagatcccattttagaaccaaaccagggtgctgaaaacacatgtaggataatgggccatcatcctaaagccccaaagtaggaaaatgggtaggaagggtaggtgggggtaggaagtcactattataagggaagggggatggggatttttccattcttaaaaagtttttgggaggaggggaaattccaggctatttaaagttcattaaatttttaagaagtatggtccatttcccattttcaggcttcaaggggaggtgtcagcaagtattatctcccactttcaatctcccctcccaagctctaccnctgggagggagtctgtccccacttctgtcaagttggaatctccttccctttccaactcttacctccctcacttcgagctcctttgcccctggattcagagaaaggggattcaaggggggttggggaggggggggaaaggaggaccaggccttgggtccccttaaggcctcccaggaaacgtttttctttaattccccaccttttctttacttcccaaaaaagaattgaacacccctgcactctgggagtggtgttatactgccacaatcaagtgtttgagtcaagtccccagaggagaggggaaccctccctccatcctttttttgcaacatcaacatttcttccttttgcctgttgccttcccccctcacacactttggttttttttctatcctacattttgagatttctaattttatgttgaaccttgcctgcttttttttcatattgaaaaagatgacatcggccccaagagcccaaaaataaatggggattggaaaaaaaaaaaaaaaaaaaaaaaaaaaaaaaaaaaaaaaaa

SEQ ID NO: 3555 - DNA, 8014 bp, Homo sapiens
  misc_feature (1)...(8014): n = A,T,C or G
cgcgacctcagatcagacgtggcgacccgctgaatttaagcatattagtcagcggaggaaaagaaactaaccaggattccctcagtaacggcgagtgaacagggaagagcccagcgccgaatccccgccccgcggcggggcgcggggacgatgtggcgtacggaagacccgctccccgggggcccgctcgtggggggcccaagtccttctgatcgaggcccagcccgtggacggtgtcgaggccggtagcggacaccggcgcgccgggcccgcggtgcttcccggaagtcgggttgcttgggaatgcagcccaaagcgggtggtaaacttccatctaaggctaaataccggccccgagaccgaatagtcaacaagtcccgtaaggaaaagtttgaaaaagaactttgaagagagagttcaagagggcgtgaaaccgttaagaggtaaacgggtggggtccgcgcagtccgcccggaggattcaacccggcggcgggtccggccgtgtcggcggctcggcggatctttcccgccccccgttcctcccgacccctccacccgccctcccttcccccgccgcccctcctcctcctccccggagggggcgggctccggcgggtgcgggggtgggcgggcggggccgggggtggggtcggcgggggaccgtcccccggaccggcgaccggccgccgccgggcgcatttccaggcggtgcgccgcgaccggctccgggacggctgggaaggcccggcggggaaggtggctcggggggccccgtccgtccgtccgtcctcctcctcccccgtctccgccccccggccccgcgtcctccctcgggagggcgcgcgggtcggggcggcggcggcggcggcggtggcggcggcggcgggggcggcgggaccgaaaccccccccgagtgttacagcccccccggcagcagcactcgccgaatcccggggccgagggagcgagacccgtcgccgcgctctcccccctcccggcgcccacccccgcggggaatcccccgcgaggggggtctcccccgcgggggcgcgccggcgtctcctcgtgggggggccgggccacccctcccacggcgcgaccgctctcccacccctcctccccgcgcccccgccccggcgacggggggggtgccgcgcgcgggtcggggggcggggcggactgtccccagtgcgccccgggcgggtcgcgccgtcgggcccgggggaggttctctcggggccacgcgcgcgtcccccgaagagggggacggcggagcgagcgcacggggtcggcggcgacgtcggctacccacccgacccgtcttgaaacacgtgaccaaggagtctaacacgtgcgcggagtcgggggctcgcacgaaagccgccgtggcgcaagtgaaggtgaaggccggcgcgctcgccggccgaggtgggatcccgaggcctctccagatcgccgagggcgcaccaaccggcccgtttcgcccgccgcgcccggggaggtggagcacgagcgacacgtgttaggacccgaaagatggtgaaactatgcctgggcagggcgaagcccagagggaaactctggtggaggtccgtagcggagtccgtgacgtgcaaactcgtgtcgtccgaacctgtggtatagcgggcgaaagactaatcgaaccatctagtagctaggttccctcccgaagtttccctcacggatagctggcgctctcgcagacccagacgcacccccgccaacgcagttgttatccggtaaagccaattgattagaggttcttggggccgaaacgatctcaacctattcttcaaacttttaaatgggctaagagtcccggctcgctggcgtggagccgggcgttggcaatgcgagtgcctagtgggccacttttggtaagcagaactggcgctgcgggatgaaccgaacgccgggttaaggcgcatcgatgccgacgctcatcagaccccagaaaaggtcattggttgatatagacagcaggacggtggccatggaagtcggaattccgctaaggagtgtgtaacaactcacactgccgaatcaactaagcccctgaaaatgggatggcgcttggaaccgtcgggcccaatacccggcccgtcgcgaggcagtcgacgagtggacgggagcggcgggggcggcgcgcgcgcgcgcgcgtgtggtgtgcgtcggagggcggcggcggcggcggcggcgggggtgtggggtccttcccccgcccccccccccacgcctcctcccctcctcccgcccacgccccgctccccgccccccggagccccgcggacgctacgccgcgacgagtaggagggccgctgcggtgagccttgaagcctatggctttgggcccgggtggaggccgccgcaggtgcagatcttggtggtagtagcaaatattcaaacgagaactttgaaggccgaagcaggagaagtggttcgatgtgaacagcagttgaacatgggtcagtcggtcctgagagatgggcgagcgccgttccgaagggacggggcgatggcctccgttgccctcggccgattcgaaaggggagtcgggttcagatccccgaatccggagtggcggagatggcgcgccgcgaggcgtccagtgcggtaacgcgacgcgatcccggagaagcccggcgggaactccggggtagagttctcttttctttgtgaagggcagggctgccctggcaatgggttcgccccgagagaggcgcacgtgccttggaaagcgtcgcgggttccagcggcgtccggtggagctctcgctggcccttgaaaatccgggggagagggtgtaaatctcgcgccgggccgtacccatatccgcagcaggtctccaaggtgaacagcctctgcgatgttggaacaatgtaggtaagggaaagtcggcaagccggatccgtaacttcgggataacggattggctctaagggctgggtcggtcgggctggggcgcgaagcggggctgggcgcgcgccgcggctggacgaggcgcgcgccccccccacgcccggggcacccccctcgcggccctcccccgccccacccgcgcgcgccgctcgctccctccccaccccgcgccctctctctctctctctcccccgctccccgtcctcccccctccccgggggagcgccgcgtgggggcgcggcggggggagaagggtcggggcggcaggggccgcgcggcggccgccggggcggccggcgggggcaggtccccgcgaggggggccccggggacccggggggccggcggcggcgcggactctggacgcgagccgggcccttcccgtggatcgccccagctgcggcgggcgtcgcggccgcccccggggagcccggcggcggcgcggcgcgccccccacccccaccccacgtctcggtcgcgcgcgcgtccgctgggggcgggagcggtcgggcggcggcggtcggcgggcggcggggcggggcggttcgtccccccgccctacccccccggccccgtccgccccccgttcccccctcctcctcggcgcgcggcggcggcggcggcaggcggcggaggggccgcgggccggtcccccccgccgggtccgcccccggggccgcggttccgcgcggcgcctcagcctcggccggcgcgctagcagccgactgtagaactggtgcggaccaggggacatccgatctgcttgtaacttaacaacaatagcagtcgcgataggctccgcggcgggatgttgacgccgatgtgatttctgcccagtgctcttgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctgcgggccgccggtgaaataccactactctgatcgttttttcactgacccggtgaggcgggggggcgagccccgaggggctctcgcttctggcgccaagcgcccggccgcgcgccggccgggcgcgacccgctccggggacagtgccaggtggggagtttgactggggcggtacacctgtcaaacggtaacgcaggtgtcctaaggcgagctcaagggaggacagaaacctcccgtggagcagaagggcaaaagctcgcttgatcttgattttaaagtacgaatacagacccgtgaaagcggggcctcacgatccttctgaccttttgggttttaagcaggaggtgtcagaaaagttaccacagggataactggcttgtggtggccaagcgttcatagccgacgtcgctttttgcacacttcgatgtcggctcttcctatcattgtgaagcagaattcaccaagcgttggattgttcacccactaatagggaacgtgagcttgggtttagacccgtcgtgagaaagggttagttttaccctactgatgatgtgttgttgccaatgggtaatcctgctcagtacgagaggaaccgcaggttcagagcatttggtgtatgtgcttggctgaggagccaatggggccgaaagctaccatctgtggggaatatgactgaacgcctctaagtcagaatcccgcccaggcggaacgatacggcagcgccgcggagcctacggttggcctcggataagccggtcccccgcctgtccccgccggcgggccgccccccccctncagcgcgccacgcacgcggaagggcgctgaccacgccagcgccgggaacacgggagtccggttgcggaagtgcccattcgtcctgggaaacggggcgcggccggaaaggcggccgccccctcgcccgtcacgcaccgcacgttcgtggggaacctggcgctaaaccattcgtagacgacctgcttctgggtcggggtttcgtacgtagcagagcagctccctcgctgcgatctattgaaagtcagccctcgacacaagggtttgtccgcgcgcgcggcggcgtgcgtgcggggggcccggcggggcgtgcgcgtccggcgccgtccgtccttccgttcgtcttcctccctcccggcctctccgccgaccgcgggcgtggtgggggggtgggggggggacgcgcgaccccggtcggcgcgccccgcttcttcggttcccgcctcctccccgttcaccgcggggcggctcgtccgctccgggccgggacggggtccggggagcgtggtttgggagccgcggaggcggccgcgccgagccgggcccgtgcgcggtccccgtcccgggggttggccgcgcgggccccggtgggnggccacccggggtcccggccctcgcgcgtccttcctgctggctcctccgcacgggtcgaccagcagaccgcgggtggtgggcggcgggcggcgaggccgcacgggcgtccccgcacccggccgacctccgctcgtgacctctcctcggtcgggcctccggggtcgaccgcctgccgcccgcgggcgtgagactcagccgctgtctcgccgtgtcccgggtcgaccggcgggcttctccaccgagcggcggtgtaggagtgcccgtcgggacgaaccgcaaccggagcgtccccgtctcggtcggcacctccggggtcgaccagctgccgcccgcgagctccggacttagccggcgtctgcacgtgtcccgggtcgaccagcaggcggccgccggacgcagcggcgcacgcacgcgagggcgtcgattccccttcgcgcgcccgcgacctccaccggcctgggcccgacggtggagctgggaccacgcggaactccctctcctacatttttttcagccccaccgcgagtttgcgtccgcgggacttttaagagggagtcactgctgccgtcagccagtaatgcttcctccttttttgcttttaggttttgctcttgcctttttttttttttttttctttctttctttctttctttctttctttctttctttctttctttctttctcgctctcgcctctcgctctctccctcgctcgttttctttctctttctctttctctctctctctctctctctctctctctgtctctcgctctcgccctctctctcttctctctctctctctctctctctctgtctctcgctctcgccctctctctctctcttctctctgtctctctctctctctctctctctctctctctctgtcgctctcgccctctcgctctctctctgtctctgtctgtgtctctctctctccctccctccctccctccctccctccctccctccccttccttggcgccttctcggctcttgagacttagccgctgtctcgccgtaccccgggtcgaccggcgggccttctccaccgagcggcgtgccacagtgcccgtcgggacgagccggacccgccgcgtccccgtctcggtcggcacctccggggtcgaccagctgccgcccgcgagctccggacttagccggcgtctgcacgtgtcccgggtcgaccagcaggcggccgccggacgcagcggcgcaccgacgcgagggcgctgattcccgttcacgcgcccgcgcccccaccggcctcggcccgccgtggagctgggaccacgcggaactccctctcctacatttttttcagccccaccgcgagtttgcgtccgcgggacctttaagagggagtcactgctgccgtcagccagtactgcctcctcctttttcgcttttaggttttgtcttgcctttttttttttttttttttttttttttttctttctttctttctttctttctttctttctttctttctttctttctttcgctctctgctctctgctctctccctcgctcgtttctcttctctttctctttctctctctctctctctctctctctctctcgttctctgcttctcgccctctctctctctctcttctctcgtctctctcgttctctctctctctctctctctctctctctctctctctctctctctccctccccctccctccctctctccccttccttggtgccttctcggctcttgagacttagccgctgtctcgccgtgtcccgggtcgaccggcgggccttctccaccgagcggcgtgtaagagtgcccgtcgggacgagccggacccgccgcgtccccgtctcggtcggcacctccggggtcgaccagctgccgcccgcgagctccggacttagccggcgtctgcacgtgtcccgggtcgaccagcaggcggccgccggacgctgcggcgcactgacgcgagggcgtcgattccggttcacgcgccggcgacctccaccggcctcggcccgcggtggagctgggaccacgcggaactccctctcctacatttttttcagccccactgcgagtttgcgtccgcgggacttttaagagggagtcactaagagggagtgctgcctgccgtcagccagtaatgcttcctccttttttgctttttggttttgccttgcgttttctttctttctttctttctttctttctttctttctttctttctttctttcttttctttctttctttctttctttctttctctctctctctctctctctctgtctctctcccctccctccctccttggtgccttctcggctcgctgctgctgctgcctctgcctccacggttcaagcaaacagcaagttttctatttcgagtaaagacgtaatttcaccattttggccgggctggtctcgaactcccgacctagtgatccgcccgcctcgggctcccaaagactgcttggagtacagatgtgagccaccatgccccggccgttcccttcttttttcaatcttatttcctgaac

SEQ ID NO: 3556 - DNA, 2095 bp, Homo sapiens
acttcagagaaagcgacctcaagatacaactggcaactgaggaaaaggcctcaattcaacaagagctaacaagcttgggagtttatttcggaatctttaaaagactcttctgcttacccacaatctgggatccactgcaggaaaacaaaaaaggaaaacttcatttaaaagaagcaagaagtaaaatgggacaaattgggaatgtttaagtctctgaaactctgcactgaaaagaaaataagattgataacttaagcttaacattctgaggcataaagaaacattaactttggagtattcatcttgactactgaaatacaagtttagaagacaagtggtttcattctggtcacagatcacagcttttctttaaatttataatcctatgggttggactcgttgactgtattttttaaaggttgctcgtcagttaactgagccttggaattcatggattttctaaagactaacaaatgaaaatattttcctgttgaagaacccagcggaaattttacagcaacaaatttcatgtttcttttgggtatttctgagaaaaaggaaatatttataaaaccatccaaagatccagataatttgcaaataaattggaggttatagaggttataatctgaatcccaaaggagactgcagctgatgaaagtgcttccaaactgaaaattggacgtgcctttacgatggtaagcgttaacagctcccactgcttctataatgactcctttaagtacactttgtatgggtgcatgttcagcatggtgtttgtgcttgggttagtatccaattgtgttgccatatacattttcatctgcgtcctcaaagtccgaaatgaaactacaacttacatgattaacttggcaatgtcagacttgctttttgtttttactttacccttcaggattttttacttcacaacacggaattggccatttggagatttactttgtaagatttctgtgatgctgttttataccaacatgtacggaagcattctgttcttaacctgtattagtgtagatcgatttctggcaattgtctacccatttaagtcaaagactctaagaaccaaaagaaatgcaaagattgtttgcactggcgtgtggttaactgtgatcggaggaagtgcacccgccgtttttgttcagtctacccactctcagggtaacaatgcctcagaagcctgctttgaaaattttccagaagccacatggaaaacatatctctcaaggattgtaattttcatcgaaatagtgggattttttattcctctatttttaaatgtaacttgttctagtatggtgctaaaaactttaaccaaacctgttacattaagtagaagcaaaataaacaaaactaaggttttaaaaatgatttttgtacatttgatcatattctgtttctgttttgttccttacaatatcaatcttattttatattctcttgtgagaacacaaacatttgttaattgctcagtagtggcagcagtaaggacaatgtacccaatcactctctgtattgctgtttccaactgttgttttgaccctatagtttactactttacatcggacacaattcagaattcaataaaaatgaaaaactggtctgtcaggagaagtgacttcagattctctgaagttcatggtgcagagaattttattcagcataacctacagaccttaaaaagtaagatatttgacaatgaatctgctgcctgaaataaaaccattaggactcactgggacagaactttcaagttccttcaactgtgaaaagtgtctttttggacaaactatttttccacctccaaaagaaattaacacatggacattttaaagtctttagtataaagaaaatttgtattcaatgtgttaagcattaacatgtattttatttgtgtatccactccatctgatttttctgagccattttgatttgttccttcattaaaaaaaatctcttaaagttaattagtgtctaaaagtgactgacttaaattatgtggtgccaatctgtaatgtctttgaattcctttttatattaaatgatttaatttactaaattattttatactaatttaaaa

SEQ ID NO: 3557 - DNA, 886 bp, Homo sapiens
  misc_feature (1)...(886): n = A,T,C or G
acacatggacntttaaagtctttatcataaagaaatttgtattcaatgtgttaagcattaacatgtattttatttgtgtatccactccatctgatttttctgagccattttgatttgttccttcattaaaaaaaatctcttaaagttaaaaaaaaaaaaaaaaaaaaaaaaaaaaaaaaaaaaaaaaaaaaaaaaaaaaaaaaaaaaaaaaaaaaaaaaaaaaaaaccccgggggggggcccggnncccanttcgcccnanngggggccgnnttncantncncgggccgncgttttanaacgncgngncngggaaancccnggggttncccancttaanngccttgcggnananccccctttngccagcnggggnaanngcgaagnggcccgcacngntggcccttccnaanagttgcgcncctgaanggggaanggcaaattgtaagcgnnaaaatttggntaaatncggggaaattttgggnaaacccngccnnttttaacccaatnggccggaatcggggaaancccctataaannccaagggatancccggnaaggggtnnagngtggnccccgttggggaccaggggccccccnttaaaaggnccggggggccccacgggcaaaggggngggaaaaccggctntacaggggggnggccccccnncngggggcccaccccccggaaccaaggttttngggggccaagggcccgnaanccccnaaccnggggcccccaaagggggcccccgntttanggcctccnggggaanccgngananggggngaaaaaggngggggaaanccnaaaggcggnnccaaggggctggaaanttnnngggccccgtgggggnacccccanacccgggggggtttcaangggt

SEQ ID NO: 3558 - DNA, 994 bp, Homo sapiens
agcggccgccctttttttttttttttttttttttttttttttttttttttttttttttttttttttttttttttgttcttaagtaatttattttaaaattataagatttacagtgccttgattatgcaaaatagcataatggaaattaaaccaaatcaataaaccaaagagaaagaaaacttaattttctctagtatccatacttaaaccatctttgtaagtatctgatgtcccaaccatgtcttatgtagaaagtataatcgtttcaaatgtttcacttgcaggtttaatttctcattttcaatttttatgaactgtaatgcaatttcaaatcctattatacctagtgtttatactgcaacagcagcaaatctcacatgtgtaatcaaatgtggaactggggcacagcttctagctgtagacagaaattatacactgcattcagtccaggagagtacattacattaaccagagcgtagagtttagtacacttattgcagggttggtatttctttccctctgatctgaatcagctgagctgctgagcagacatattactgctgtggatagtaagactgctgtgggggctgagggaaggggtatgaaggctgctggggtcccgggtatggagcctgtccaggactctggtgatacactggtggatatggcatattatactggccatacgcataaggattatagcccatgggcatgggcatttggcaatacccaggataagaaaacagaaaaaatcttgattggtaaatcaaatactaaaaaataaaacaataatcattctagaactacgtttttcatgaaagtcatttctattttttagtctattaaagaacagtggagtgaaaaaaactgtttcaaggcacttgtcagagaaaagcattcctatcctgttattaattaaaacaaaagagtaccaagtgtttaatactatccaaaaataaatactgaagaaaataagaataaatattcgagtatt

SEQ ID NO: 3559 - DNA, 755 bp, Homo sapiens
  misc_feature (1)...(755): n = A,T,C or G
atttgtatgtttatttgaagaatctttggtagcaactgtttgtttcttccacattataggactttctaaaataaatgtcaaaaatcgtttactaatcagcatacgaaagataaagtatgataatattcttttgatttccctgtaaaacatccttgataataacttgtactattcatgcacttaaaaacagtatctgtttaacttatatacatacaaaatgagactaataccagaaaaaaaattagacagtaatgagaatcaataacaaaacataacaatgacaactgttcttaagtaatttattttaaaattataagatttacagtgccttgattatgcaaaatagcataatggaaattaaaccaaatcaataaaccaaagagaaagaaaacttaattttctctagtatccatacttaaaccatctttgtaagtatctgatgtcccaaccatgtcttatgtagaaagtataatcgtttcaaatgtttactgccaggtttatttctcattttcaattttatgaactgaaggcaattcaaatctatttaccccaanggttaatactgcacacagcaattacaatttgtatcaaatggggaacggggacagatttttcttggaacaaattttcctgttttttcccgggaaaacattatttcccgcgggggggggtttacctttacggggggggggttttttctccctttttaaaaaaaggaggggggaacaaataatcttggtagaaaaaataggggt

SEQ ID NO: 3560 - DNA, 463 bp, Homo sapiens
gttcttaagtaatttattttaaaattataagatttacagtgccttgattatgcaaaatagcataatgggaattataccaaatcagcaaacccaagagggaggagagctatttttcgccagggtcgacacgtagaccagccttgtaagggaggggggtccgcaccacgtgctgtgtgggaaggaaaacgtttcaaaagtgtcacttgcaggggtaagttctcattttcaatttttatgaactggaagggaatttcagatcctattatacctagtgtttatactgcaacagcagcaaatctcacatgtgtaatcaaatgtggaactggggcacagcttctagctgtagacagaaattatacactgcattcagtccaggagagtacattacattaaccagagcgtagagtttagtacacttattgcagggttggtatttctctccctctgatctgaatcagctgag

SEQ ID NO: 3561 - DNA, 846 bp, Homo sapiens
  misc_feature (1)...(846): n = A,T,C or G
ttatttttgagacagagtcttgctctatcgcccaggctagagtgcaatggcacgatctcggctcactgcaacctctgcctcccaggttcatgcaattcccctgcctcagcctccccaagtagttcggattacaggtgcctgccaccaaacccagctaatttttgtattttttttagagatggggtttcgtcatgttggtcaggctgatcttgaactactgacgtcaggtgatctgcccgccttggcctccccaagtgctgggattacaggcataagccactgcgcccagcctcccattttttcaatctcctcagttcttctattctcaacgttttttgacttcacctttcgtttccctgatttgattttaattctccttcatgagtttcaaagttgaactcaattggcctgttgctatttcattgtttatctccgattctggttgggctactgtatatgtgatgcccttctttatctctgaaaacaagactctagcccattgtttgaaatcctcgagtttccctgttgggagattccatttcaggtattagatttaatccgtgttcctggctgttctgatccattcttccccaaaataagccaataactaattccataaaattttctttttgtctgtacttctgctttaattatctgantccttgctgttaataccaaacagcacacaanatttggttttgggttttatgagacaaagtctcactctgttgcctggacgagtacagtggcaccatcactgctaactgaagcctccacctcctgtgttcaagcgatcttcccgcctcagcatccctactagctgggactacagacttgcagcaccac

SEQ ID NO: 3562 - DNA, 668 bp, Homo sapiens
aaatctcggggtgcctttactgtaacaagttatgctcggctctcttttattttacaagaggatggtgagggagagaatggaagaacagagggggcggacgtataagacatttgacactgcctatgtctgatttctctttctttctttctttctttctttctttctttctttctttccttcctttctttctttcttgcaagctgtgatcggatgcaatctttgtgggacatttaaatggaagggttcattgatgtgtattgcttgccaagccaaaatgttgcctttggggaaaagggagagaggtgttcatggagtgcagggaaaggaggttttggggcagagattttgacttaaaataaccagacttcttctggctgctgaaaagaggcaaaagttttaaattgtcaagtttaaaactatgttcagttatgatttgccacttctgaatattattttggatttcccctttcatgcttattttgttcagaatcctaatgaatagaggttgctggactcagggtaaaagcaggatgaactggagatgggacatacaaggtacttttggaattgccatagattacacctataatcagagtaaatgtcatcaacaaataatcaaaatattttttacatttgctcttctaaaatcagagcctattttaaatata

SEQ ID NO: 3563 - DNA, 1483 bp, Homo sapiens
atatacatgaattaacatttatacatttatttccatccaaatgtctcagaaacagtctaagaatcacaatttcagtgttttgcactgagctaaaacagctgcatgcaatggatgtcttatcaaatcatgataagctttagataaattctaatgacttgatgttacccaagaacttgaactgacagattttcatttttgtctccaggaatgaacaggcagtccaaatactgttagtagttacattatataaagcacacaattaaatgtccaaatacaggcttggtagccttctaatcacattttgggagatactgtttataaaaagacaaatatagtaaacagtaaaatgcttactagtcccatgtcctgtgaccccaccttgcccaacaacaggaaaaccccaccaaaatgaaaatatgaaaatcaactcatgtaataaacctcttcagaggcaaaagactttagaggcaaaagacttaatgattaacggttgacttttaagactttactgcacattcagatatgttggaatcaattgagtttttatactctgaacagcaattaaatccagtctttacccgtcctattgctaaagaatatgacaaaagagtcttggtctcagaagtaggagcagcaagtgattactcatgatggcaatgatgcaccacattctgcagtgatgctcacatgcctgaatttcatctgaagcatgaaagttcccaaatcctgcaacagggtttcctttgttggagtccccgtccttgccgtcttcacttctataatcagctatgtgcctttgcagcaaatcaggaaaagctgtgttgagggttacaacttccagacatttaggtcttaacttccatcacagaaagcaatgcacttttttgaatatattaagaaaatatttattcatcccttcaagccactcactttcagaaagacaattgaacatccattttatcaaccttcatttaacccttttcctgtttagaaaaaaaaaaattgccagcgctaatttacataaacattctctttgaggcttaagcaaatctaactgattttcaatgtgaaaaaagataaaaactgagttatttctaaagagaacatcagaattgtctatttcaaaaaaattggattcatcaaatgaatcttcggccaacaactgttcgagaatgatgttaacatcatgtataggcatgctacgttttctaggatttgacattttcagtaatcaagagttactatattttgtaaatggaaataccgctactaaaaaaaaaaaagaatgctataaatagaacaatgtcttttgtttccaaagtccatatactagaatgatgtgaaaataataaaagcgaaatatttcgtaggcaaagttatcttggggtaaatgctacaactgcaaagccactggcgagtattctcggggcaaacagaaagaaggttaaatcaaataaaatcattccctaagtcacccaagagc

SEQ ID NO: 3564 - DNA, 478 bp, Homo sapiens
  misc_feature (1)...(478): n = A,T,C or G
tttttttttcttttgagcaggagtgaaagtattaaaaagctttagagcaggaatgaaaggaaggaaagtacacttggaagagggtcaagcaggggacttgagggatcaaatgcgtggtttgaccttttgacttggggttttatatgttggcatacttctggggtcttgcgttacttctcccctgattcttcaaaaagcacctatttcttaaggatccaaaaaaataaaaaccaatttcattgctgctgtttccatttcttggcaaaaattaggaaacacaactaaataaatatccacgggaataaaatgggtgcatttattcaccaaagtcttattcacacgtgggagatgaataaggaacttcccgaggccaaggaacagtattatacaacntggggaaatttctctaggggntatttaaggtggaatttaaccncctggaatttccacttttaaggttaggccntggggttgcttt

SEQ ID NO: 3565 - DNA, 491 bp, Homo sapiens
ttttttttttacatttaaatacttactttatttaacccaatatacccaaactattatcatttcaatatattatcaatataaaaatcaatcataaaatatttaacattttttcatattaggtctttaaaatccagtgtatattttacacttacagtacatctcaacatcgcaattcagttactaaattttcaccagaaaaatctatatttcatacgggtcactgttgaggaagtggggttcacacatctaggttttttccaaacataaaacattttcccaataactggaatcggaatctctggtctttaaattttttaaattaaaccaattttaaattcccttccctcggctggtcccccccccccctcaagcattcaatagccacatgtggccaatggctaccatattggacagcaaagcttcagacattgcaacctggcgtatagactaaggtctccttggcagtggtgggtggacaaagtatccctcaa

SEQ ID NO: 3566 - DNA, 1770 bp, Homo sapiens
aatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaacccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggatttttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgtaaaaaaaaaaaaaaaaaaaaaaaaa

SEQ ID NO: 3567 - DNA, 296 bp, Homo sapiens
  misc_feature (1)...(296): n = A,T,C or G
attcctaccttgtacaacatctgatcattcatactggagagaaaccttacagatgtaatgtatgtggaaaggtcttccatcatatttcacaccttgcacaacatcagagaatccacactggagagaaaccttacaaatgtnacgtgcatgcttaagcttttacccaggcatnaaaaccggaacatcacagggtttatactggagagtaactacacaaagataatgtaataagcctttcagtgtaatattcatgattttgtcgtgagagatccactcaataaaaaccaggcaaatgt

SEQ ID NO: 3568 - DNA, 182 bp, Homo sapiens
tttttttattcaacaatttactggcagctcttcgccaacaggcaatagggcaaaaaaagcttgagagaaacaaaaacactgagagtgggaaaccattatgacttcaaacgttcatcaactcagagaatccatactaaagagcatttatataattatttgatagagatttccacaggccaaag

SEQ ID NO: 3569 - DNA, 714 bp, Homo sapiens
cagcgtacttacaacctcagtttcaccacgataggctggtacattttattatttgtcacttatttttgttttaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3570 - DNA, 1790 bp, Homo sapiens
  misc_feature (1)...(1790): n = A,T,C or G
cttccagtcgctcgagagcggagagcggcaccatggccccgcgggggcggcggcggccgcggcctcacaggtctgagggcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatctgaaaactcagaaaaaagggaagatatctcatgacaaaaggaagaaatcaagaagtaaagccataggcccagatacttctgacattgtgcacatttggtgtccagaaggaatgaaaaccagtgacatccaggagttggatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaaggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattgggtttacaggaaggtaaaaaacaaaaattgggaaaggcaaagtaataaaacttaggttttatattaaacagggttngaatggntatattttattccaaatctccaccaggaccntccggggccaaattataggccccgggggggncccaaagtgttttccctagggtggaatttaggnttccncccctggtnatta

SEQ ID NO: 3571 - DNA, 449 bp, Homo sapiens
acaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgtta

SEQ ID NO: 3572 - DNA, 408 bp, Homo sapiens
gggcgcaagacgttcaaagaacactttagaaagaacacattccatgaaagataaagctggtcaaaagtgcaagcctatcgacgtgttcgactttcctgataattctgatgtctcaagcattggcaggctgggtgaaaatgagaaagatgaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttga

SEQ ID NO: 3573 - DNA, 375 bp, Homo sapiens
  misc_feature (1)...(375): n = A,T,C or G
aactccgatgaccaaaaattgctaaggacaaccaggccaanaaanaaatgcccacaatgggaatggtgnactggaaagatggctccccatctcagggtgaagggcttcggaagcccctcatgctgtacatggcatgtgtatctctgctcttctccagaaggcacatgtgtctttggggggtccgcgcgctgcagcgtctccttcccgttctccaggtatctgcggagccactccacgcacaggccctccaggtaggctctcagctgctccgccttacgggccgcctcccacttgcgctgggtgatctgagccgccgtgtccgccgcggtccaggagctcaggtcctcgttcagggcgatgtaatccttgccgtng

SEQ ID NO: 3574 - DNA, 598 bp, Homo sapiens
  misc_feature (1)...(598): n = A,T,C or G
catgttntgacgagctgganagtcctcttttcactgagtcttctctacacatacaacagccacatactcctagacagctagacagccaggacagccagccagcaacgatgcccacgatggggatggtgggctgggaagacggcttccatctcagggtgagggctccggcagcccctcgtgctgaacatggcacgtgtatctctgctcttctccagaaggcaccaccacagctgcccacttctggaaggttccatctcctgctggcctggtctccacaagctcggtcagcctgtgcctggcgcttgtacttctgtgtctcccggtcccaatactccggcccctcctgctccacccacgntcccgcggctcccctcttggactcgcggcgtcgctgtcgaaccgcacgaactgcgtgtcgtccacgtagcccactgcgatgaacggggctccccgcggccgggccaggacacggatgtggagaaatacctcatggagtgggagccggcccaggtctcggtcagggccagggctcccgagagcagcaggatgagggttcggggcgccatgacccgcatctcggcgtctggggagaatctga

SEQ ID NO: 3575 - DNA, 395 bp, Homo sapiens
ctggaaggttttcaggtctttatttgctctctcaacttccaggaattgacttatttaattaatccatcaacctctcatagcaaatatttgagaaaacaaatttatattcagattcttattttcagtagggaagtaagaagttgcagctcagtacacgtaaagttgagacagagatggagacatccagcccacttctctggaacaggtatctgcggagccactccacgcacgtgccctccaggtaggctctccgctgctccgcctcacgggccgcctcccactagcgctggggatctgagccgccttgtccgcggcggtccaggagcgcaggtcctcattcaggggcatgtaatcctttggcgtcgtaggcggaactggttatacccccgcggagg

SEQ ID NO: 3576 - DNA, 298 bp, Homo sapiens
  misc_feature (1)...(298): n = A,T,C or G
aaaggcagctgtgcatctcagtcgcacacaaggcagctgtctcaggntttacaagctgtgagactcagacccctgggnactgtcgctccactcagccttagagtagctccctccttttccacctgagctcttcttcctccatatcacagcagcaaccacagctccagagatggggtggtgagtcacgtgtgtctttgggggctccaggtgaagcagcgtctccttccccttctccaggtatttgtggagccactccacgcatgtgtcttccaggtaggctctctggtntccgcctcag

SEQ ID NO: 3577 - DNA, 323 bp, Homo sapiens
gtctccctgagtcttggcccaagagctatctgagaaaccagggagaaaccctcgtcatgtgccccgtccctcttcatttttcatcccggaatccccgtcccagaactggactccctgcctcccactccttacctatttccctgaactcttctagaaaaaaactcaccccagggagcttggtgacagagagggagctcgccgccagagagggagctcgccctgggaatggaggcgtagagacagtggtagcagaatcttggcaaccctaaatgatcagtggtcctgctcctgtgagtcagagtgtgttatttcctcacctaaaa

SEQ ID NO: 3578 - DNA, 472 bp, Homo sapiens
tttctggaaggttctcaggtctttatttgctctctcaacttctaggaattgacttatttaattaacccatcaacgcttcatagcaaatatttgagaacacaaatttatattcaggttcttaacttcattagggaagtaagaagctgcagctcagtgcaccatgaagttgagacagagatggagacatccagccccacctctctggaacaggaaagatgatcggggagggaacacaggtcagtatggggacaggggtcacggtggacacgggggtgagctgtctctccaactcctcatattatgctaacaggaacgcagcgtctccttcccgttctccaggtatccgcggagcactccacgcactcgccctccaggtaggctctcagctgctccgcctcacgggccgcctccaacttgcgctgggagatctgagccgccgtgtccgccgcggtccaggagcgcaggtcctcgt

SEQ ID NO: 3579 - DNA, 490 bp, Homo sapiens
  misc_feature (1)...(490): n = A,T,C or G
acaaatgatgctcaaacacngcttttattttacttcaaagtttacctcacnacagcctgggaaggtgaggggaatgaagnagatgctgttaaagggtcatgggagagaaaaggtatctgtgggaagagaataatctcttttgacttcgtgtgctgcctcacngacacactggagcagcgtctcctttcccttctccaggtatttgtggagccactccacgcatgtgtcttccaggtaggctctctgntgctccgcctcagaggcatcatttgacttntgctcggagatctgagnccgcgtgtccacnccggtccaggagcgcaggtcctcattcaggntgagataatccttgccgcgtaggcgaactgtnatacccgcggaggaagcgcccgtcgggccccnactcgcagccatgcatccacctgcaggtgtgagaccncgcctcgctcttattgtagagccgcgcagcgtcncgaggtcactccggaaa

SEQ ID NO: 3580 - DNA, 618 bp, Homo sapiens
ggactctggaaggttctcatgtgttccatttattttgtctctcaaattttaggaatcttctcctttaattaactcatcaacctctcatggcaagaatttgagaaagtaaatttatactcaggttctaattttaatagggaaggaagaagttacagctcagtgcaccatgaagttgagacagagatggagacacctcagccccacctctctgcaacaggaaagatgattggggagggagcacaggtcagcgtgggaagagggtgtgagaaccggcctcgctctggttgtagtagcggagcgcgatccgcaggttctctcggtcagtctgtgagtgggccttcactttccctgtctcctcgtcccaatactccggcccctcctgctctatccacggcgcccgcggctccatcctctggctcgcggcgtcgctgtcgaaccgcacgaactgcgtgtcgtccacgtagcccacggcgatgaagcggggctccccgcggccgggccgggacacggatgtggagaaatacctcatggagtgggagcctgcccaggtctgggtcagggccagggcccccgagagtagcaggaccagggttcgggggcgccatgacgggcccctcg

SEQ ID NO: 3581 - DNA, 458 bp, Homo sapiens
tggcgaatccccaaggcggggcctccccaatccatacaccgccttcggggcctgagaccctgagagccacgcctggggccctgggacttcgccctgaccccgctcctcctgtgccaagcgctctgtctcagtgtttccctgagtcttggcccaggagctgtctgagaaaccaggaagaaaccctcggcatgggccctgtccctctcccttcacttttcatccaggaatctccgtccctgaactggactccctgtccacctggactcttctagaagaaaagtcacccacggagtttggtgacagagagtgagcttgctctgggaatggaggtgtagaaactgttttttgttttcctttttttttttttttttattgggaaaagttgtgcctgagtgcatgagacagaatagagaccagtttatttatttatttgtttattaaatacattggatagcaaa

SEQ ID NO: 3582 - DNA, 459 bp, Homo sapiens
ttttttttttttttttttttttttttttttacacttagattctaattttaatacagaagtaagttatagctcagtggaccacaaatttgagacagagacggagacatcccagccccttttctggaacaggaaaggtgattggggaaggaatgcagttcagcatgaggaagagggtcatggtgggcacaggggtgggctggtctctgcacaaagagaagtcagggttcttgaagtcacaaagggaaggcatgaacaaatcttgccactcagtcccacacagggcagctgtttcacattgcagcctgagagtagctccctccttttcaatctgagctcttcttcctccacagcacagcagcgaccgcagctccagtgactacagctgcaaggacaaccaggccagcaacgatacccatgatggggatggtgggcagggaagactgcttccatctcagcatg

SEQ ID NO: 3583 - DNA, 999 bp, Homo sapiens
gaatagagaccagtttatttatttatttgtttattaaatacattggatagcagaaccttggtaacccctgaatgatcaggaatctaatcggtaaaaaatgtgactttggccccatgatgtataaatgtgcccaaaagcgttacaacaggactcacaaagcttctaagtttcacttttgcagtgtacctgtgactcccgcttgtcatattttaaatttgccatcattccatagctttgagtttctgtgtgagtccaggatatctcctcaatacaaagtagcacactgtgtactttgcaaccaggtacgttacaaccaggagtcagtacaggctttattcacctcaaagttgcaactgttcaatgtagtcgcaatgcccctcactagtgctcatgcactgcctgtttttaggaagtatccactgctaagtgttgtgtatattttataggaacacttagtaatttttaaacctgattaacattaaaaaattagtttttaggcagacccacatgaggtattaaaggccaactgccaaggacaccctgctaggctctgtagatggatgtattaaaatccataaaacaatgtatttaaacctaagaattctgctgctttcgaattctttcctctgctccttttcttcacctcctgcttctccagcccttctctccgtccttttcatccttcaggccctcctgtccccttagtccccaccacactgtcacttgtgagttgtgacactagcactgtcccatgacctgttacgtgactgttcttttcacagtggtcctgctcctgggagtcggagtgtgtcatctctccacttaaaacactccagtgtctccacctcggtcttgagaaacttctggagtgtcaggcacgtgagcatatgaggggatatctggtttatcgtagggactaaattaatttttgtcgactgaatgaatgaaatatgagtgtattaaattgcattacagataattataaagtgcaaaacacgg

SEQ ID NO: 3584 - DNA, 550 bp, Homo sapiens
gggtagcagaatcttggtaacccctgaatgatcaggaatctaatcggtaaaaacatgtgactttggccccttgatatataaagtgtctaaaagcattacaacaggactcacaaagctcctaagtttcacttttgcaaacaaggtatctgtgactcccgcttgtggtgttttaaatttacctttattccgtagccctgagtttctgtgagtccaggacatctcctcaatacaaagtagccactgtgttcctatgtgttgcaaccaggagtcagtacagacttcattcacctcaaagttgcaagcgctcgatgcagtcacaatgtccatcaccagtgctcatgcactgcctgtttttaggaagtatccacatctaagtggtgtgtatatttcttaggaacacttagtatttttaaaacctgattaacataaaaacaattagtttttaagcagacccacttaaggtattaaaggccaactgcaagtaacaccctgcgaggctctgtagatggatctattgaaataccattaaaaaaagtgttcaaacctaaaa

SEQ ID NO: 3585 - DNA, 851 bp, Homo sapiens
ttttaaggttctcatgtcttccatttattttgtctctcaaattttaggaatcttctcctttaattaacccatcaacctctcatggcaagaatttgaaaaagtaaatttatactcagattctaattttaatagggaagtaagaagttacagctcagtgcacataaagttgagacagagatggagacatctcagcctcacctctatggagcaggaatgattaattattggagagggaacacaggtcagcatgagggaagagggtcatggtggacatgggggtgggttggtctccccacctcctcatattatgcctacaggaacacaggcacattcaggtgcctttgcagaaagagagtcagggtttttgaagtcacaaagggaaggcgtgaacaaatcttgcctctcagtcccacacaaggcagctgtctcacactttacaagccgtgagagacacatcagaaccctgcgcatggtcgctgcttgccctttcagaagtaagctcactctatctgtgggaagaaaatgtcctgagttcttcttcctgcacatcacagcagaaaccacagctccagtgactacagctccaaggagaaccaggccagcaatgatgcccacgatggggatggtgggctgagaagactgctcccatctcagggtgaggggcttgggcaacccctcatgctgcacatggcacatgtatctctgttcctctccagaaggcaccaccacagctgcccacttctggagggtccatcccctgaaagcccttggtctttaaaaagcttccatttcccgattctggtcctctccatcttgctgccagcttcagtgtgatctccacaggtagagcc

SEQ ID NO: 3586 - DNA, 1463 bp, Homo sapiens
ctcgtcatgggccccgtccctcttcatttttcatcccggaatccccgtcccagaactggactccctgcctcccactccttacctatttccctgaactcttctagaaaaaaactcaccccagggagcttggtgacagagagggagctcgccgccagagagggagctcgccctgggaatggaggcgtagagacaggtttttgtttttttttctttaaatccggaaaagttgtgcctgagtacatgagacagcatagagacaagttttctctttgtttattaactacagtgggtagcagaatcttggcaacccctgaatgatcaggaatctaatcggtaaaaaaatgtaactttggccccttgatctataaatgtgtctgaaagcattacaacaggactcacaaagctactaagtttgactttcgcagacaatatatctgtgactcccgcttgttttttacatttaccttcattccacagccctgagttactgggtgagtccaagacatctcctcaatataaagtagcacactgtgttactatatgttgcaaccgggagccagtacagactttattcacctcacagtttgcaagtgttcaatgcagtcacaatgcccctcagcagtgctcatgcgctgcctgtttttaggaagtattcacgtctaagtggtgtgtatatcttataggaacacttagtatttttaaaacctgattaattaaaaaaaaattagtttctaggcagtcccaaatatagtattaaaggccaactgcaaagaaggaacactaagtgttttttaaaccttattaacataaaaaaacattagtttttaggcagtcctacattaggtattaaaggccaactgcaaagaacactgagcgaggctctgtagatggatgtaataaaaatctataaaacaatgtgtttaaacctaagaattctactgctttccaattccttccctctgctccttttcctaacctcctgcttctccagcccttccctctgtccctttcacccctcaggccctcctctccccttagtccccaccaccctgtcacttctaaattgtggctctagcattgtcccattacctgctatgtgactgttctctccacagtggtcctgctcctgtgagtcagagtgtgtcatttcctcacctaaaacactccagtggctccacctcggtcttgtgaagcttctagaatgtcaggcacgtgagcatatgagggcatacctggttcatcttaggcactaaattaatttttgttgactgaatgaatgaaatatgaatgtattaaattgcatcacagaaagttataaaatgtaaaacactgaaaaattaagaaatattttattttatgtaactagtgtgcatatcaattcattccgagtctgttgagcctgtgtatgaattttataagattgcataacaaattatcacaaacattgactttaaacaacaccc

SEQ ID NO: 3587 - DNA, 1314 bp, Homo sapiens
ttttttttttttttttttttttttttttataaaaagatatatttttattctttatttttaaaatttatgtatgttcgggaggcacaagtgcaattctgctacattgatatcttgcttctcagtcccacacaaggaagctgtctcacactatagagaaaatattcatgaacaaattcgtatcagtcacagtgaggaggtaacactctaaatagcccatttcatgctcaagacatccaagtcaaagaaacccaatagcacagctgagtcccctctgttccccccccaacaccccactcacatcagggcccctgcccctggagtgtcacctttattagctgtgaggagacaccccagaagccctgggcactgtcagtgattggggtagaacaaaaacaggacctggtcagagcccacagatgtggctagaggaactgtggggtgggtgagctccctcataggctcctgaccacaatatcccaacaatctcagggatcagcctccttcatcttacctgcagcctgagagtagctccctctgtttctatcttgagctcttcttcctccacatcacagcagcgaccacagctccagtgaccacagctccaaggacaaacaaggccagcaacgatgcccacggatggggggatgggtggggctgggggagacttgctcccatctcagggatgagggggctgggggcagccctcggttggcttggcacatggggcatgtggtatcctctggttcctctccagaaggcaccacccacaggcgggcccattttttgggaaaggtttccatcccctggcaggccttggtctccacaagctcttgtgtcctgggggtctgttcctccccatcccgttgccagggtcagcgtgatactccgcagggtagaaagcccagggcccagcaccttcagggtggcctcatgggtcagagattggggtgggtgggcaacgtgtgccttttggaagatctgcgcgcttgtagcgtcttccctgcccattctccaagtatctgcggagcaactccaggcactcggccctccaggtaggtcctgaactcctctgcatattcctctgcctcatagaagcgctgggtgatctgagccacggtgtccgccgcggtccaggagcgcaggtcctcgttcagggagatgtaatccttgccgtcgtacgcgtgctggtgatacccgcggaggaggcgtccgtcgggccccatgtcgcagccattcattccctggagggtgtgagacccagcctcgctctggttgtagcggcggagcaggttcctcagggccactcggtcagtc

SEQ ID NO: 3588 - DNA, 1393 bp, Homo sapiens
ttttttttttttttttttttttttttctttttttattttttaatttttattttttgagatggcgtttcaccctgtcacccaggctggagtgcaagtcgcacaaatcctggctcactgcaacctccgcctcccgggttgacgccattctcctgcctccgcctcctgagtagctgggactacaggcccgtgcctctgcgcccagctaattttttgtattttttagtagagacggggttttcaccgtgtttagcccaggatggtttcaatctcctgaacctccttgaatctgcccctccctcggccttccccctaagtgctgggatttaccaggcattggactgcccgcactctgccccaggttctttattttttaatagaaaagagaaacagggaaaggaacacaggtcaagtgtgagggaaggggggtcatgggtaggacacagaggttggacttgtttctctacctccttcaacattgtgctaacagggggacacagaccagattcagaaggccctttgcaaaaagagaagccagagtcccctaagacacatagggggaggcgtgaggaaatcctgcatctcaagtcgcacacaaggcagctgtgcatctcagttcgcacacaaggcagctgtctcaggctttacaaggctgttagactcagacccctgggcaatgtcgctccattcagcctttaaagtagctccctccttttccacctggggtcttcttcctccaaatcaaagcagcaaccacagctccagagaccacagatccaaggagaaccaggcccagcaatgatgcccacgatgggggatgggtgggctggggaagcgggcttcccatctcaggggtgacgggctcggggtagcccctcatgctgcacatggcacgtgtatctctgctcctctccagtaaggcaccaccacagctgccccacttctggaaggttccatcccctgcaggcctggtctcccacgagctccgtgtcctgggtatggccctccccatcctgctgccagggtcagtgtgatctccgcagggtagaaagccaagggcccagcacctcagggtggcctcatggtcaagagattgggtggtgaagcacgtgtgtctttgggggctcccaggtgaagcagcgtctccttccccttctccagggtatttgtggagccacttccacggcatgtgtcttccaggtagggctctctggtgctccgcctcagaggcatcatttgacttttgctcggagatctgagccgccgtgtccaccgctggtccaggagcgcaggtcctcattcagggtgagataatccttgccgtcgtaggcgaactgttcatacccgcggaggaagcgcctgtcgggccccagctcgcagccatgcatccactgca

SEQ ID NO: 3589 - DNA, 1066 bp, Homo sapiens
  misc_feature (1)...(1066): n = A,T,C or G
ttttttttttttttttttttttttttttttctggaaggttcctcaggtctttactttgcttctctcaaaattcccaggaattgacttatttaaattaaacccctcaacctcctcataagccaaatatttggagaaaacaaattttataattcaagattcttattttcccagtagggaagtaagaagttgccagctcagtgccacattaaattgaaaacagagatggaaaacatccagccccaaccccttctggaaccaggaaaggattgacttggggaggaaacacagggtcagcattgggaacaaggggtcacaagtggacacaaagggtgggctggtctctccaaccttcctccacattaatgcttaacagggacgcagacgacattcaaggtgcctttgcaagaaagaagaatgccagagcgtcctttggaagtcaacaaaaggggaggcgtgaagaaatcctgcaatctcagtccctcaacaaagacagctgtctcaaggctttttcaagctggtgagagacacatcaagagcccctggggcacttgttcgctggacgccagcctgaggagtagctcccctccttttccacctgagctcttcctcctacacatcacagtagcgaccacagcgaccacagctacggtgaccaccaactgctagggacagcgcagggcccaggncacaattgcccaccgatggggggacggtgggactgggaagatgggctccccatcttcatagtggtgaggggcttcggcaagcccctccgtgctgtacatggcatgtgtatctctgctcctcgtcaggaaggcaccacccacagctgcccactttctggaaggttctatcttcctgctggtctggtctccacaagctcagtgttcctgagtttggtcctcggcatccccgctgccaggtcagtgtgatctccgcagggtagaacccagggcccagcacctcagggtggcctcatggtcagagacggggtggtgggtcacgtgtgtctttggggggtccgcgnctgcagcgtctccttcccgttctccaggtatctgcggag

SEQ ID NO: 3590 - DNA, 5030 bp, Homo sapiens
ttttttcaggttaaaacacattgttttatatattttaatacatcaatctacagagccttgcagggtgatctttgcagttggcctttaataccttatgtgggtctgcctaaaaactaatttttttatgttaatcaggtttaaaaaatactaagtgttcatataaaatatacacaacacttagaagtggatacttcctaaaaacaggcagtgcatgagcactggtgaggggcattgtgactgcattgagtgcttgccactgtgagatgaataaagtccgtactggctcctggttacaacatatagtaacacagtggctaccttgtattaggagatgtcctggactcacacagaaactccagggctatggaatgaaggtaaatttaaaatactacaagcgggagtcacagatacattgtctgggaaagtgaaacttaggagctttgtgattcctgttgtaatgcttttagacacatttatatgtcaagggaccaaagtcacatttttggccgattagattcctgatcattaggagttaccaagattctgctacccactgtagttaataaacaaaaagcaaactggtctctattctatctcatgcactcaggcacaacttttccagatttaaaaaacaaacaaacaacaacaacaaaaaaccctgtctctacacctccattcccagggcaagctcactctctggcaacaagctccctggggtgatttttcttctagaagagtccacggggacaggtaaggagtaggaggcagggagtccagttctgggacggggattccgtgatgcaaagtgaagagagagggacggggcccattccgagggtttctccctggtttccacagacagatccttggccaggactcaggcacacagtgtgacaaagatgcttggtgtaggagaagagggatcaggacgaagtcccagggcctcaggcgtggctctcaggatctcaggccccaaaggcggtgtatggattggggaggcccagcgctgggcattccccatctttgcagggtttctcttctccctctcccaacctgtgtcgggtccttcttcctgggtactcaccgggctgccccagttctcactcccattgagtgtcgggtttctagagaagccaatcaatgtagccgcggtcccggttctaaagttcccacgcacccaccgggactccgattcttcccagtcgccgaggatggccgtcatggcgccccgaaccctcctcctgctactctcgggggccctggccctgacccagacctgggcgggtgagtgcggggtcgggagggaaatcggccctctgcggggagaagcaaggggcccgcctggcgggggcgcaagacccgggaagccgcgccgggaggagggtcgggcgggtctcagccccctccttgctcccaggctcccactccatgaggtatttccacaccgccatgtcccggcccggccgcggggagccccgcttcatcaccgtgggctacgtggacgacacgctgttcgtgaggttcgacagcgacgccacgagtccgaggaaggagccgcgggcgccatggatagagcaggaggggccggagtattgggaagaaggagacagggaaccgccaagcgccaaagcacagttttaccgagtgaaacttgcggaccctgagcggcttacttacaaaccagagtgaggcctgtgagtgacaccggccgggggcgcaggtcactacccctccacatcccccacgtacggcccggggtcgccccgagtctccgggtccgagatccaccccaaggtgatcttgcggaacccgcccagaccctcgaccggagagagccccagtcacctttacccggtttcattttcagtttaggccaaaaatccccccgggttggtcggggcggggcggggcggggctcgggggacggggctgaccgcggggcctgggccagggtctcacacccatctagaggatgtctgtctgcgacgtggggtcggacgggcgcctactccgcgggtatcaccagcttgcttacgatggcaaggattacatcgtcctgaacgaggacctgcgctcttggaccgcggcggacatggcggctcagatcaccaagcgcaagtgggagactccgcccatgaggcggagcagcagagaggctaacttggacggcacgtgcgttggacgggcttcgcagatacctggagaacgggaaggagacgctgcagcgcacgggtaccaggggccacggggcgcctccctgatcgcctgtagatctcccgggctggccctcccacaaggaggggagacaattgggaccaacactagaatatcgccctccctctggtcttgagggagaggaatcctcctgggtttccagatcctgtaccagagagtgactctgaggttccgccctgctctctgacacaattaagggataaaatctctgacggaatgacggaaagacgatccctcgaatactgatgactggttccctttgacacacaccggcagcagccttgggcccgtgacttttcctctcaggccttgttctctgcttaaaacttaaatgtgtgtgggggtctgagtccagcacttctgagtccctcagcctccactcaggtcaggaccagaagtcgctgttccctcttcagggactagaattttccacggaataggagattatcccaggtgcctgtgtccaggctggtgtctgggttctgtgctcccttccccatcccaggtgtcctgtccattctcaagatagccacatgtgtgctggaggagtgtcccatgacagatgcaaaatgcctgaatgttctgactcttcctgacagacgcccccaagacgcatatgactcaccacgctgtctctgaccatgaggccaccctgaggtgctgggccctgagcttctaccctgcggagatcacactgacctggcagcgggatggggaggaccagacccaggacacggagctcgtggagaccaggcctgcaggggatgggaccttccagaagtgggcgtctgtggtggtgccttctggacaggagcagagatacacctgccatgtgcagcatgagggtctgcccaagcccctcaccctgagatggggtaaggagggagacgggggtgtcatgtcttttagggaaagcaggagcctctctggagacctttagcagggtcagggcccctcaccttcccctcttttcccagagccatcttcccagcccaccgtccccatcgtgggcatcattgctggcctggttctccttggagctgtgatcactggagctgtggtcgctgctgtgatgtggaggaggaacagctcaggtggagaaggggtgaagggtggggtctgagatttcttgtctcactgagggttccaagccccagctagaaatgtcccctgtctcattactgggaaggaccatccacaatcatgggccgacccagcctgggccctgtgtgccagcacttactcttttgtaaagcacctgtgacaatgaaggacagatttatcaccctgattatggcggtgatgggacctgatcccagcagtcacaagtcacaggggaaggtccctgacgacagatctctggagggcgattggtccagggcccacatctgctttcttcatgtttcctgatcctgccctgggtctgcagtcacacatttctggaaacttctctggggtccaagactaggaggttcctctaggaccttaaggccctggctcactttctggtatctcacaggacattttcttcccacagatagaaaaggagggagctactctcaggctgcaagtaagtatgaaggaggctgatgcctgaggtccttgggatattgtgtttgggagcccatgggggagctcaaccaccccacaattcctcctctagccacatcttctgtgggatctgaccaggttctgtttttgttctaccccaggcagtgacagtgcccagggctctgatgtgtctctcacagcttgtaaaggtgagagcttggagggcctgatgtgtgttgggtgttgggcggaaccgtggacacagctgtgctatggggtttctttgcattggatgtattgagcatgcgatgggctgtttaaagtgtgacccctcactgtgacagatatgaagttgttcatgaatatttttttctatagtgtgagacagctgccttgtgtgggactgagaggcaagatttgttcctgcccttccctttgtgacttgaagaaccctgactttgtttctgcaaaggcacctgcatgtgtctgtgttcttgtaggcataatgtgaggaggtggggagaaccaccccacccccaatgtccaccatgaccctcttcccaacgctgaacctgtgctccctccccaatcatctttcctgttgcagagaggtggggctgagttgtctccatctctgtctgaacttcatggtgcactgagctgtaacttctccttccctattaaaattagaacctgagtataaatttactttctcaaattcttgccatgagaggttgatgagttaattaaaggagaagattcctaaaatttgagagacaaaataaatggaacacatgagaaccttccagagtccacgtgttgcttatgctgatttgttgcaggggaggagactagatggggctgtgccagttttctgttcggccaccatgggctttatgtggtcactgcttgggtgggtcatccttgctgctccactgcccgaggcccttcagtagaaccttgtcccacacaagacccgtgattacagggagttggatgtcacctagggtggtccctgcatacaaatctccttgtggtagcaagagacaaatttttagacctgtccaggtcttgccttcctcccagggctttttcctcattgtattttcgatttttcctacaatctttttaaaggaaccagattgtgacatttgcagagaggaggggtccatagtttctcatcatgattaaccttctggtggactcctcttctgctctcctactctgctcctgcttagtgtagt

SEQ ID NO: 3591 - DNA, 1735 bp, Homo sapiens
  misc_feature (1)...(1735): n = A,T,C or G
tttttttttttttttttttttttttttttttttttttttggaagggtctcaggtcctttatttgctctcctcnaacttcccaggaattgacttagtttgaatgaatccatcaaccccttcatacaaattatttgagaaaaccaaatttatattcaggttcttaacttccattagggaagtaaagaagttgcagctcagtgccaccatgaagttgagacagagatggagaacaaccagccccacttcctctggaaacaggaaagatgaatcggggagggaaacacaggtcaagcatgggaaacaggggtccacggtggaacacggggggtgggctggtctctccaacttcctcaacatttatgcttaacaggaacgcaagacacattcagaatgcctttggcagaaagagaatgccagaggctcttgaaagttacaaagggagagttgtgaaagaaatcctggcatctcagtcccacacaggccgagctgtcttcaggctttacaaagcgatgagagacttcaatcaagagcccttgggcacttgtttgttggacgcagcctgagagcagctcccttccttttccacctgagctttttccttcctacacatcatagcggtgaccacagcagcgaccacagctccgatgaccacaactgctaggacagctaggacagccaggacagccaggacagccaggacagccnaggcccagcaacgatgccccacgaatgggggatggtggaactgggaaagatggctccccatctcagggttgaagggctccttggcagccccctcatgcctgtacatggccatgtgtatctctgctcttctcccagaaggcaaccaaccacagctgcccactttctggaaaagttctaactcctgctgggcctgggtctccaaaaagctcgttgtcctaagtttggtcctcgcccatcccgctgcccaggtcaagtgtgaatctccgcaagggtaagaaagcccagggcccaagcacctcaagggtgacctcatggtcaagagatggggtggtgggtcaacatgtgtctttggggggttcctgcgcgcctgccagcgtctcctttcccgttctccccagggtatctgctggagccacctccacgcagcaggccctccatggtaggctctccagctgctccgccacacgggccgccttcccactttgcgctgggtgattctgagccgcgggtgtccgccgctggtccaggagctcaggtcctcatttcagggtgagataatccttgcccgtcggtaggcggactgggtaatgccccgcggaaggaaggcgcccgtccggcccccacgtcgcaagccgtacatcggtctgccaaagtgtgagaccccggccttcgctctgattgttagttagccggagcaagcggtgcgcaggcttctctcgggtcagtcttgtgcggtgtcccttgtaagatctgtgtgttccggtccaaaatactccggcccctcctgcttatatcccacggcgcccgcggctccttctctacggactcgctggcgtcgctgtcgaaaccgcacgaactgcgtgtcgtccacgtagcccacagagatcgaagcggggctctcgcgcggccgggccgggatcacggcggtgtcgaaatacctcatggagtgggagccggcccaaggtctcggtcagggccacgggcggccgagagcagcaggaggaccggttcggggcgccgtgaccccggg

SEQ ID NO: 3592 - DNA, 6044 bp, Homo sapiens
ggttggttggttatttatttacttgatacacttcatttttaagagtagctttagggttacagaaagttgagcaaaaagtatagagaattctcatataaccctttcccctcccatcttccacaggctccccaatcattaacatcttgcatcattatggttcatttgttacaattaatgagccaacagtgatacattattattaactgaagtccagagttgacattagggtttactctgtgttttccgttcactgttttccattctctgcgttttgacaaattacagtaccctagagagtactttcactgccttaaaaatcacctctctacctgccatccctcctttcccctcaactctcagcaaccactggtcctttcactggctcaatagttttgcctctcccaaaatgtcatataattgcaatcatacaaaatagaaagccttttcagattggttttcacttaacaataagcatttagggtttctccgtgtcttttaatgacttgatgtccaattcctttttatcatctacctgaggactgtatcctgcaatcctgctgtaattgcttattaatgtcagcagggtttttgttatttagaattctctacaaagacaatcatgttacttgtgaacaaagttgtatttcatcctttcaaatctatgtgcattttatttcttttttttttaacactgcattatatagcacttccagtacaatgctgaaaagcagtggtgtggtgttccttgccatgttcctgatcttagtaggaaagtgtctagttggaaacatcaaggataatgttagctgtagggttttttgtagtatgttctttaccaacttgagtaagttctcctgtattccttctgtgttgagaggttttaacatgaatggatattggattttgtcaaatgctttttctgtacctattgatatgatcgtatttcatctttgagctgctaatgcatgcaatggattacactgaatatcaaatgttgaacaagccttgcattcctgatttgctaatattttgaggatttctgcatctgtgttcaatggaaatattgatctgtagttttcctttcttgtaatatctttgcctggttttgctattagggtaatactggcctcacaaaatgagttgggaagtgttatctctgcttttattttctgaaagagatggtagagacttggtatcatttctaccttaagtatctcaaaaacacatcagtgaacccagctggtcctggcactttgttttggaaagtttcattattattttttgagatgcagtctcattctgtcacccaggctgcagtacagtggcacaatctcagctcactgcaacatccacctcccaggttcaagtgattcttctgcctcagcctcctgagtagcttcgactacacacgcatgccaccatgcccagctaattttttgtatttttagtagatagggggtttcaccatgttgaccaggctggtctcgaactcctgaccttgtgatccacccgcctcagcctcccaaagtgaagtgctgggattacaggcatgaaccactgtacctggccttggaaggttattaattactgctttggtttatttaatagatacatatgcctattgaggtctatcttgtgtgagctttgagagaatgcgtcttgcaaggaattggtccattttagctaagttatcaaatttatggacagagttgtccatgtttctttctaatccttttggtgaccataggattagctgtgatggcctctttcatttttggtattagcaatatttgtcttctgtttgttcttaagctagctagaggtttatcaattttactgaccttttcaaggaaccagttttgggttttatcgattttctcttttcaatttcaatgatttttactctaatgttttttcaggttactttggatttaatttgctcttctttttctagtttcctaaagtggaagcttagattacttgtgtaatctaggatcactagactgtataatcttagattatttgtatgatctgatcatgtaatatagtgtacaatcttcacactatcaataaaagccccacaccagcttgattctggttctgctccagcctcaaccctcctcttcatattctcaaaagtctgagggcccagatccctgtctggggacaatgagccttgaaatgacagtccaacagccctgggcagccctgggctgtatgtgtgggcctttccagggccctgtcttggagagcagctgcttaaagaaaatttggactaccacttatgctgaaggctggaatgttcacatatgtaccctaggcacttcatggcatggcatgagccacaggtaggaagagaaagggagtaacatggaggcgagcctagatcttcacatgtacaggatagattttttttagataatttgttattttgatttataccttttaaatggataaacattagctctgtgggtctccttttaaattgtttcaggacatcacaaacatctgggatgggcctgataatgtaaccactactaaactaggatacctacttcctattcacaattacgttaaattccattatgcatatgaaacacacgatttatatcacataccacttatacatatataagtcttttgaacttcagggataattcgcagatgtgcttaatgctattgccctgattattcaatttatctgtgctttaaaaaaacttcatagtcaagtggatgcaagggatagggttgcagaaagcgtgtggttattaatacaaaaagggaactacttgaggctaaatcctttgtaatcctgatacagtacagatctcagattccttttcagttctgtaaactaatcgtgttgatggttactcaaatgtaaaagtcgtaaaagtttgatataaccacacacacacacatacacgtacacacacacacagagtgcatgcaaaccatagtaaaatctgactaagtctctatctaccagcaaggtaacatcgatttcttggacttgaccatatactatgattatacattatccttagaggaagtttggtgaagtgtacatgggaattctctctactcattaaacttcttgtgaggttattttaattattacctttgtttaagttcttaaagctttacattccacaatatacatctataaattattgttaggtgccctaaaaactattatggcatcaaactcaaaacataacttgtcgtattttatttctaagcaaaattttcactttagatttcttaaattgacaattttctcctcagtgtaaattctaacataaccttatttgcatttttgccaaaaactttcacaaattcaaaaaaaatctgtaaggtgttatgcccgtattaaccatctgatattacatagaatatcacttcctaacaaaagctgtcctataattgttgtagtctatgggtttatcccctactattactttggagtaacataaggtgagtttgtggatagttactgaacattcaggatgtcatcagggctttctccacagtgtgaatactctgaggcattatggaggctgacttgtggctggaaatttctaatatccatttcattcataaggttttctcctatatgtcttctctgatgtacaatgagatttgacttttgagagaaagttttcctgcatgtgttacattcatagggcttttcccctgtatgtgatctctgatgttgagcaagttccgatttacggtaaaagatttttccacattcattacattgacaagatttctctcctgtgtgagccctgtgatgtactgtgagtgatgatttgtgcctgaagaatttcccacattcattgcattcatagggtttctcccccgtgtgctttctctcatggaaaataagtcctgattttacacagaaagattttccacattcattacatttatagggcttttcttgtgtatgggttctctgatgtacaattagagctgacttatggcagaaagcttttccacactcattacatttatagggtttctcccctatgtgaattctctgatgctgagtgagttgtgacttctggcagaaggtttttccacattcattacattcatagggtttctcccctgtatgtgttctattatgttttgttaggtatgatttattgtaaaagatttttccacattcatgacattcatagggtttctcccccgtgtgtgttctataatgttgagagagggttgacttatggctaaagaatttcccacattcgggacatgcaaagggtttctgccctgtgtgtgttctctgatgtactgtgaggtctgacttcaagcagaaggttttcccacattcataacattcataaggtttccaccctgtatgaattatctgatgcctggtgagtaatgacttgtggtagaaagttttcccacatgcattacattcataagatttatctcctatgtgaattctctgatgctgtgtaagatttgacttttcactaaaggatttcccacactcaagacattcaaaaggtttctcacctgtgtgagttctctggtgtactttaaggtgcgaagtcacacggaaggattttccacattcataacattcatagggtttctgccctgtgtgtgttctctgatgtttagtgaggtcagatttctggtaaaaagttttcccacatgcattacactgatagggtttctcccctgtatgtgttctctggtgtaatgtgagggctgacttatggctaaaggctttcccacattcattgcattcaaaaggtttctcccctgtgtgtgatctctgatgtttagtgaggtttgacttctcccagaaagcttttccacattcattacattgaaagggtttctctcctgtgtgcaccctctgatgtcgagtgagatgtgacttctcccagaaagctttcccacattcattacattcaaagtgtttctctcctttatcacctttctgaagctgtgacagacacaatttcctcctgaaattattcccactttcaccacaatcatagtgtttcacaggtaccccatcaggtttagaaagggtggacttcacacataagaacttctcacaatcactaaattcatagtgactgtcccttgacggaggtatctgatggaacaagagggatgaactatcacacaaagttctcccaaattcattatagtcacagttattctcttctgcgttctctctcttccgtgtattgaatactgccttttcaaggagggtttcctgacatatactgtattcaaaattgtgctctaaagtttgaatcttctcatgctgcaaagtctcctcacgatgactcagtgtgttcctatttttcaaaacttcatttttctctcgagtatgagtttcatcatgcttaatattgagtaacaatttcccacaggcattaaattcgtcagacttttttcctaaatagtttatcttactgataaccaattctgaaacagtgttgaaactcattccacatgagtcatactgacagaacatttttctggaaggaaaagaacttacgtccatgttaaatggtattcctattacattaccttgttccttagtcagcatttcattattgatgaatacaacttcccacaaatgtttagattgattttcttggctcctctctttcaggtgatcagctgtccagacttctggaaagctctggcttgggaattcttcctcctgtttccatggctcttctccttgttgcagcctgaagatcacctctggtttgtgaacacaataccccactgagacaaggttgctgtagttctccagcatcacatctctatacagagccctctgactagggtccaggtgctgccactcctcctgggtgaagcccacagtcacatctttaaatgatactgactcctgggacttctgttctaccttgttcattttgttctgttcttggaaagacggagacaactctgaagatacagcccactccctcgtcgggttgcattcgccatagaaaagcgcgtagacccttgaaatcccgggaccgcctccc

SEQ ID NO: 3593 - DNA, 1249 bp, Homo sapiens
  misc_feature (1)...(1249): n = A,T,C or G
gagcttgagccaaaccaagtntggggtgggaaagatgtnaaggaagattgacacacaccctttggccaagctctggctttagatgccagccagtgtctcctagcccgggaccttttcntctggagatcacagatgggagagagaaggaagtgattcttggtattgagctcaaatagatacttaaaattatgtagactaattcggataaaacttgaatcttcttttcccacttagatttggtttcaaaaccagataggacacctgaggctgagctggctgcagtgtggacgctcctcgggaggacagcagctccaaggacacgagaagcctcagccctgggccccaggtgagtccccagcagtgccagtgcacttcctcagtgcatctctttgaagtagaaacgtctctttaggctgtttccaaatttgttgcagagaatgctgatgtctcttccacagcacgccagtgttggagatgtgaccaccatccccacctcatgggaaggtagtttggaagaagggaaggccattgatcttccagtcctggtgtggcaggcagtgcagagtcctcttcttccagcactgcaagggtttaatccaaggtccaggatcagtgcatgaacacctcaggggccttgttccttagtcagcatttcattattgatgaatacaacttcccacaaatgtttagattgattttcttggctcctctctttcaggtgatcagctgtccagacttctggaaagctctggcttgggaattcttcctccagtctccatggttcttcttcttggtcccagcctgaagatcacctctgtttgtgagcacaataccccactgagacaggggttgctgtagtctcagcatcacatctctatacagagccctctgactagggtcccagtgctgccactcctcctgggtgaattctatagtcacgtccttgaatgacactgatgccaccttctgcaagttggcccacagtgttcagtgtcacacaatctgtgatggcttctggatgtggcgacatcaccaagtctggtgctctctgggcaaggggatgaagaagtgccgctggttgggcaaatcaagacctgctcctttctgggttcttctgcatctgtttggaagccctggtgaggaggtctctgttctgtcagagagcagttcttcggtgggactcctgttcctggggctccctcgcttccgtgagctgcgaacctctctgcaccagcaaacactaacaggg

SEQ ID NO: 3594 - DNA, 5171 bp, Homo sapiens
tttttttttttttttttttttttttttttcagataaagagacctttattttgtacagtacatggtactgtaaaagtaccatgtacttttaccatgtcacccagtgtcacatgggtgattttttgccataccagtaaaatgatggatccaggtagcaaccgtcacaatctggatggagaaagctgtcggcagcttgattccagtcagtcttatcagaaaatagtctcttattatgggcatctacttgagcaacccagatggttgtactaagcagctgtgacttttacccccactgtacaaagaaagggtgctttttaatctgtaatttccaattagaatatcaaatatctaggccacatccagagccaaggcttaacaaaaatgtaacatggtttatgaaatggagtattggccagagctgagaacatcctcgtgctctttccactgagaggagtgaccgcttcactttgggtttgttaatggcactgagtttgaacacacacaggatcctagtagtttcagttggcgaaagcatcagtgagccaggcccaattacagtaacctctatgaattgagggctctactaagccagcaactttgcttcgttctggaaagaggtgatacattatttcccttctaagagacagctactactattgcctatacagctgacatactgtggggccaggacaggtgctttcctgaatgccccattttcattccacaagtgaggcttgctgggtccttttcattttgttagttgttgagtccaagacgacaaactcctaaagtggaattttaggtcagaaccctctacccaaggaagagatatccaatgtgtaaaagagcccaagagtaaactaacagctgcttttcagaaggggtggacctggtacccttgtcagggaaccaagtcaatcccctggcccccagctcccaagggctgcccccttttgccagaagtttcaacccacaaaatcaccagtcacagagagagacttgaagcccaaaatgatcagagctgttggacctcagaggtatctttacatacaattattcctgattagaattctatgacttatgcgaattacagggaattagaattctctctataacttatgggaattaatccctactacactttcagatgtaaacataactgtagtatactctactggcccaaagtacctcacccataaagttattaaatttgtttgccttcccattgccaaaccccattagctaaatctaggtgtcctgtacccccacaggaactagtaagatgttgccttgggcatggattcaataaagccatataaatctgagtccctcccctctctggaggtttcccataatacttgggtgggtgccaatggcctttggagccagggaaaactccttaaagcagatatagctggggtatatggaggtgtcaggaggtgtgggggcagtacctctgtgcaattaaggcacacttacgttgaactgcacagtggctgctcaccattcagccaaaagacttttaggttcatgcaaagccctgtatcaggtggtactatcaatttcattacattgaaaggatgtcttttccacaattctctgatcatatttgaggttctccttgactctctagcctcctaataaggtttgtgccctctgattgacttaagcctggcttacacagaagctttctgccttcctagcagaagataactaaattatgtgtagaaacaaatagactcaaacatgtgaaagctcaacagaatacagtagtccctgcttaactacaaggaatgctctccaagaattccaagttgatgtttgaaaccacgggtatactgaaccctgtatatactatatttttttcctacatatacacatgcctatgatagtttaatctcttgctgtgcctaatttataaattaaggactaataatggaataattacaacaacatgccagaaatgctcttgcaatttcaggccattatttagtaaaacaagggttacttgaatacaagcactgtcataccctgacaggtgatctgataactaaaatgtcaagtaagtgactaactggcagatagtgtatacactgtggatatgctagactaaggaatgattcaataaccctcatgggagagcaggagggcatgagacttcatcccactactcagaatcgggtgcagtttaaaatgtaggaattgtttatttctggatccatttaataactttaaagtacagttgaccatggttaatggaaattgcgtaaagtgaaaatacagataaggggggactactgtataagcttaaattttgctcacataatgttcaactgggaaagacacagaagaggagaattttgctgcgtgtattcattcaggcacagacttctttatcttgtaccatgccacattaaagcacggcaccaagcttgtcctagaaatgatatccattttgttgtgacagggccctggtaatttattagggaagtctcttatgtttcagactgggatgtgatatacatcatggacatccacatcttagtagccagtcacaaagaccaacctggatgaaaaggagattgggaaatctggactatgtgcctggagtaaaatgaaattggtgctggtgaagagattaccagcctgtgtgatgtgtgggagctatctaatagggtatgacttcattcaggcctatccatagtactctgaaaacagaagcctgtctgaattctttgatacactctgaaggttgcattttggacacaattcttcctgcattcatcttcatctggtttctttcctatgtgaattctctgattcacagtgagggtttacttctgggactgtcttcttacattcactaccctcaattggttttttgtgtatctctgatatcaaatggggtattccttttgtcaaaaggattttctagttattacatcaatagggattcccctctccctgaattttctggtataagcttagggtagacttcttacataatttcccatattcattgcattcataagatttctccccactgtgagtcctttgatgtattctgaggtttgatttctggccaaaagttttcccacatttattacactgaaagggtttctcccctgtgtgaattctctgatgatcactaaggattgctttccggacaaatttcttcccacattcattacatttaaatggtttctccccagtgtgaattctttgatgcactctgagggttgatgtccgggcaaaagttttcccacattcgttacatttgaatggtttctctcccgtgtgagttttctgatgttgaatgagatgatcttttcgccagaaggatttttcacattcattacactggtaagttttctccccagtgtgagttctctgatgtattctgaggtttgacttctggccaaatgtttttccacattgattgcattgaaaggatttctcccctgtgtgaattctgtgatgatctctgagggtggacttctgaacaaaagttttcccacattcactacattcatagggtttttctcctgtgtgaattctttgatgtcccctgagggttgacttctggacaaatgtttttccacattcattacatttatagggtttttctgctgtatgaattctctgatgagtactgaggtgtgacttctgggagaaagtttttccacattcactacattcaaatggtttctctcctgtgtgagttctctgatgttgaatgagatgtcctttctgacagaaggatttcccacattcattacatttatagggtttcatcattgagtgacttcttcggcgaactctgtgaaccgacgtctggtaggatttcttattttcatgatattcagaggatttaacccaagtctgtgttctgtcattacttaccaatgggttctcttctatgacagctgtttgaggatcagtgaggtgtgcctttctgttgaaattatttccacttggatttaattcataatgttttatacccatattaagtttattatattcctccacagttgacttctcaaaggatttcccacattgattaagatgcaggtgtttcttccctgtgccagttctcctgtggtcaaagagagttttcttatcacaatttttcctaaattcatcatctttagaggatgtttctcctgtgtgagaactgttatgtttaacacagttagccttatcattaaaggcttttccaattttattacattcaaaagcttgctccaaagtttgaaactttggatgcttgggaagattttcattataattgagagctttcatgtttttattatgttcataaaatttctctccagtctgagttttctcaaagttaattttgaaaggtgaattctcacatacattaccgcaacctattttctttgttgaatagtttctattattaatgataaattcagaaatactttgcaaattcacttcccatgagttgcatttgcaggacatttttgttgaagcaacagcagctacatgcagagtaaatggtttccccaaaactttctcttcctctgtagtcaatgttttattattgatacatattgcttgctccaagtgtttgtctttgattttcttgttctgcttgatcaggtcatcacctctgtaatcttttgggtgactctggtttgagaattcctcctctgagaaccaaggctcctctccttgctccaacttgaagatcacctctggtttgaaacagcagtaccccactgagacgaggttgctgtagttctccagcatcacatctctgtacagattcttctgaacaggggccatttgctgccactcctcctgggtgaattctatagtcacgtccttgaatgacactgatgcctgagatatgttcattttctgctgctcctgaaagagtgtggagaaccgtaaaggataaccaccttctgcaagttggcccacagtgttcagtgtcacacaatctgtgatggcttctggatgtggcgacatcaccaagtctggtgctctctgggcaaggggatgaagaagtgccgctggttgggcaaatcaagacctgctcctttctgggttcttctgcatctgtttggaagccctggtgaggaggtctctgttctgtcagagagcagttcttcggtgggactcctgttcctggggctccctccttcc

SEQ ID NO: 3595 - DNA, 564 bp, Homo sapiens
gagacagagtcaaaagacggggcacacagaaaagtcatgcaacatggtggtcctaccaccacctacagcctctcctcctcattaaagtggcctatggagggcttagcccagcaggcttagagcttctacagaatgggtatctgctccctgggaggatgttctcgggacatccttcaattgcctgcagggattttgggggttgttttcaaagcacaagtgtggtcccggctaagagcagcctatcagcactctcctcggatgtgttggtttccttgatgggccaaaagaaagtgagaagccgctgaaaacacatacacttatttgccttcccttttttatgttacccactccaccatcacatttcctcttcctctttttctccatccttcatatcttccatatcttctctgagatggaggacaagaagtcagcaagtttgtgtctcggtgagttatttcaaggtacataccactctctcctgaggctgatgacatcttgttccttagtcagcatttcattattgatgaatacaacttcccacaaatgtttagattgattttcttg

SEQ ID NO: 3596 - DNA, 515 bp, Homo sapiens
aggaaaaagatgtaactttatagtggacaaactctgtttgccaagacatttcaggccaacatcaaaagtcataaaacatggtgacagtatgcatgcttgatataatgtgacaaaaaaggtactttaccactgtgggctttttcccccaaaacctataatcccagtcttatcttgagaaaaacatcagacacattccaataaatggaatttatatatacctcaccaggactcctcaactgtcaaggtcatccaaaacaaggaaagtctgggaaaccaccatagccaagaggagcctggaaagctttggcttgggaattcttcctcctgtttccatggctcttctccttgttgcagcctgaagatcacctctggtttgtgaacacaataccccactgagacaaggttgctgtagttctccagcatcacatctctatacagagccctctgactagggtccaggtgctgccactcctcctgggtgaagcccacagtcacatctttaaatgatactgact

SEQ ID NO: 3597 - DNA, 359 bp, Homo sapiens
tttttttttttttcctaaatagtttatcttactgataaccaattctgaaacagtgttgaaactcattccacatgaatcacactgacagaacatttttctggaaggaaaagaacttacatccacattaaatggtattcctattacatcaccttgttccttagtcagcatttcattattgatgaatacaacttcccacaaatgtttagattggttttcttggctcctctctttcaggtgatcagctgtctttctctcttgtgacattgacatattaagcagagtacaaggctggtgttttgtaaactgtctctcaatttgggtttgtctgatggttatactcgagattagattcagatgag

SEQ ID NO: 3598 - DNA, 394 bp, Homo sapiens
tttttttttacttttaatggaatcaactttattaattattttcttttaactgctgctttttgtgcctttaggctatctaagaaaagtcttgcaatatttaggtgttcacccctaaagtgacctggagtctaaccactcctgcagaattatgtctactactgctcagtaactcacttgggtgactctggtttgagaattcctcctctgagaaccaaggctcctctccttgctccaacttgaagatcacctctggtttgaaacagcagtaccccactgagacgaggttgctgtagttctccagcatcacatctctgtacagattcttctgaacaggggccatttgctgccactcctcctgggtgaattctatagtcacgtccttgaatgacactga

SEQ ID NO: 3599 - DNA, 523 bp, Homo sapiens
  misc_feature (1)...(523): n = A,T,C or G
ancccnaaacnaaaanangtanccccccncnanaangccccagaaaaantggncnaaaatattccccccccnaaggggtaaaaccncccaancnactaaacccccnantttggaanngtcttncccnaaaaaaacntncaaaaaaannccaaaaaaaaaaccnganagggttttantcccaagtantaaccatctgatattcaacagaatatcactncctaanaaaagccanccnanaggtgttgtagnctatgggnttaacccctactgttacnntggagtaacataaggcgaggttgtggatagttantgaacaatcaggatgtcaacaggcccntctccacagtgtgaagactctgangcattatggaggctgacttgtggctggnaatttctaatatccaaatcantcataaggnttttctcctatgtgtgttctctgatgtacaatgagatttgacttttgagagaaggttttcctgcatgtgttacattncatagggcttttcccctgtatgtgatc

SEQ ID NO: 3600 - DNA, 438 bp, Homo sapiens
  misc_feature (1)...(438): n = A,T,C or G
aataaaccggaaccccggtaaatccctaaattttnccccccaccaaatacacngcccctngatagtttaatcctcntgcctgtgcccctanttaataaatttagggacctaataanggaaataattaacaacaacatgcccagaaatgccccttgccaatttccaggcccattatttaagtaaaacaagggttacttgaaatacaagcactgtcataccctgacaggtgatctgataactaaaatgtcaagtaagtgactaactggcagatagtgtatacactgtggatatgctagactaaggaatgattcaataaccctcatgggagagcaggagggcatgagacttcatcccactactcagaatcgggtgcagtttaaaatgtaggaattgtttatttctggatccatttaataactttaaagtacagttgaccat

SEQ ID NO: 3601 - DNA, 312 bp, Homo sapiens
cctaaatagtttatcttactgataaccaattctgaaacagtgttgaaactcattccacatgaatcacactgacagaacatttttctggaaggaaaagaacttacatccacattaaatggtattcctattacatcaccttgttccttagtcagcatttcattattgatgaatacaacttcccacaaatgtttagattggttttcttggctcctctctttcaggtgatcagctgtccagacttctgccaagggctgcatatctccaaacaccaccacactttgggtgagggctccaacatatgaattctggaaa

SEQ ID NO: 3602 - DNA, 441 bp, Homo sapiens
ctcctctctttcaggtgatcagctgtccagacttcactttgggaggccaaggcaggtggatcacttgaactcaggagtttaagaccagcccaggaacatggtgaaaccccatctctggaaagctttggcttgggaattcttcctcctgtttccatggctcttctccttgttgcagcctgaagatcacctctggtttgtgaacacaataccccactgagacaaggttgctgtagttctccagcatcacatctctatacagagccctctgactagggtccaggtgctgccactcctcctgggtgaagcccacagtcacatctttaaatgatactgactcctgggacttctgttctaccttgttcattttgttctgttcttggaaagacggagacaactctgaagatacagcccaatccctcgtcgggttgcattcgccataga

SEQ ID NO: 3603 - DNA, 465 bp, Homo sapiens
tttttttttttttttttttttttttttttttgcgattgctttaaagaaagctttatttactacatacatcctaagaatgtactgtaaatggagcaagatctaaataaaagcttttcaaatataaagcagctaaagttaactaaaccactagcaatgtttgaaaacagaactctaaaactttttttttacatttatatagtttgttcttaacactaaaaaaaaaaaaagttcacatttcaagttataaacttacctcagtagtgtacatgaaatggttttgaaacaataggaacagataagtcccagataggaggctcactgatacttaattggccatgtcaccaatgtttgtttttaagggagtttggtggttgccatgttatcattttttttattctttctttctttttctttctttctttctttctttctttctttctttctttctttctttctttcttttct

SEQ ID NO: 3604 - DNA, 635 bp, Homo sapiens
ttgcaatatgaaacttatgaattgtttatttctggaattttccatttaatattttcagaccatagggaaagcaaaaccacaaataaagggactactatatgttgacccacatgaaggaacttatttcataaaaataaaaggagcaaaatatttaaaaaatatgtataagggtgtttattacaatattatttgtcgtgacaaaaaactggaaacaaacttattatggactattctgcagttatttaaaatcactatcaaatgacaatatccatcagttactaagagaggggaaagcaagtattagagtaatatgtttgcatgattctgttttttaaaaaaagtacaccatcacaatcagtgtgaacatttattcattcaacaaatatttattgagtgcctactatatgccagacactattttatgttctagtaatagagacaaacaagataattaagtattttgaatgaatacaatatttagaatgttgaaaagtgaaaaataaagcagagaagagcagaaaagtgcttgtgaagaggaaactaaaacatgaggacatctaagggacattcatggaagatgctgctgacagcacaaacaaaaagaggatggtcagtatggatagagcaaggtgact

SEQ ID NO: 3605 - DNA, 1187 bp, Homo sapiens
gatttttttagacgtattattttgggctgggctgtggctaatcttgaagcagtgacttcctattttttggctcagacccatttgggaagctgtgaacctgagataaggaagtctgaaagtactagccggcagccgaccgtttctattcctttcgaagttaaggagacagcaaaggagctcccaggaattagggatccagttataaattgcacttaactcaaaatagtgccaatgagaatgtgaaggaatcttctggaaatgaaaccccttttttcaacaaaagcaagtttggtttatttgaatggtttcattaaataagtctacaaaggtaacaaactgaagcacaaagcgcaatcttacaagaagcgcaacacccagagttagtgcaaaatgtacaattaacggctgctgagaaacccccaaagtttgaatttttatttttatttttaacagtgtacattgttaaataatgtaaggaaaacatttataattcagaaagtttttaatgtggaaaaagatactcaaagtgtactattaacacaaaaataatttaaacagttcagtagcactagttcattcctctaggcttgttatttcatacacaggaggatgaaatcaacagtaaataacaccagttctgactttttttgtgtatgagtgaaaagatgtcaaaattattattaaacccaaataacaaatgataatgtgctgcatgaggctccactgctcctctggtataaagtatgtttcactcttgggtggcccctttctcagctactcagccccttgttggttctatccttactctctccacaagaaatacaagcagagaataaataaatcattttaaagcaggggtggaagcccttgcccttttcctttctaccttttaaaaaccttcagctctcatttgcatatttagggccgtagaccaacttacttacttattaagggaagcagggcccttaaggaatgaacagggtacaggagcctccagcctctttctgtggtagtggtggtggtggtggtgattcccagaatatgccattgacgtgggtaaaaggttggaaatattttcagtttccgttccaactcgaggagtcaagagcgacccgagagatgagagggttctgaggtccctgccgtgggtcgtccgagagataacaagactcctaatcagacccagt

SEQ ID NO: 3606 - DNA, 5785 bp, Homo sapiens
tagagatggggtatcaccatgttgcccagggttggtctcgagctcctggcctcaagcaatcttcccgcctcggcctcccaaagtgctgggattacaggtgtacgccaccgtgtctggctgatttctctcatttctaatgctagggcagacagacagcactgactacgactgtggagttcagtcttcattattctaaatgacccagcaatctattgcctagataccatatccactctctgtcacagatccatgaagaagcacttctaccagaaagttacattgaaatttgtagataacttgttattttgacattttttatcataattaatgtgggggcccaaacttctgagggtaacagtaattcagccaagccactgagtagatgatatacaaaaagagacaaatgaaaatggactgcgtgaaacatcagatccaagcagcagaaacacaaggacaaggaaggagtaaaggtgttacacacaaagagccaagcagggcgtactcagaaatcgggtcctcctgccaccaggtttgaatgtcacctgttcagatgcacagttaaacttcgcacagcctgtgagaggggaaaaacagggtagaacagagagaggagaagagacagaacacaactacaagatgttagaaacttgaggctggagtggtgaaatgcactaagatggcacacagaagaacaagcttctggggggaaggtcagatatgtaagagatgaaatattaggtcttaattctacccatctgcaaaatgcggaagcttttcttagttcgaataatgctagctagtttgccctccttaccaatcaagtgcattcttcctgtgaagagactgatctctaatttctgtgaaactgtggcaaaggcacataagccagtacctatatttttttcattcttctcacccagatgcccaagtcttttcaattcttgttctaatatgactaaaagctctttcctctgtgggaattttttcagcaatcactaataaacagagctatatttggaaagtagattatggataaaaaactgaattgtaaggttattcattttagtatgccactcccatacttaaaagtaacaaaattctacaatggctaagaaaatgtattagcttcagaaactgctaaaacaccttagaatttcatccaggaaatctcagcctaatattaaagcctaagttccaaatcccaaatgagcaagtcatataggccacacagatgtaacttttcactgtaattccttgaaaaaaagtaatttcacctaatgggagcagtgagcccaccgattctcattatcactccacttcccttttcacccagattcttcagtgtacaacacacaggctgtgttctggtcagctagtctcccaacccgccttaacaggcttttgtcccaggtatggcaacatctccattttattgtttttggacgatgatggttgctttattaccttgacctggagcagaaaggcttggtactgaaatggcaccatcactggtgaaggctgaatagaggttgtcactggagggagatggcttaaggggctgtaacagctgattctgcccggactctgggatgttgccaggagggtggagggtctgctgggggtgcaagactgaagctgcactctgaccagacaggttacctgaaagctgggggcttttattccccaaggaactgcttcgactagatttgctgcctttgcttttagtgggtcgtcgtcttctccctgaaaggggagcagctgggggaataataacagcagggggcaccttgcccagtttggtatacaaagattcaatttcatgcttctggcgactctgcaggtcctgaatctctttgagatgtttatctcgtagtcgtcgcagctctaactttaagtcttcatcttcgatatctgactcattgtcgctactcatgtaagaggagttaaatgaattactaaggctttgacttagattctggctaggaaggctctttgagctcagctgatggggcgagtgtggactaccggaaccatcatccacatccctacttaaaaaagcggcctccgggtcagaagacggcccatttagatgtgaaggctctgacagttcaggcttctctttctttggtatcacagcaggaagaacagcttgttccaaatccataaaaggaggagatgccactggtccttctttctttgtgtcagtgatcttgtcctcagtttttgatacagagaaacgacccactttgtttgctgtagttgtcacctgaaaacgtccaaccttggtaggctgcccagtgtctgactttgcctctgaggcagtagttttgtgggcactctctggcacatctgaagagataccagggatggttatgccattcggctctggtttcaccaaggtactctctggactactacttgatagcactgaggactctgaggtgctggattcaaaatgaacagactttgcatcttctgacttatttttaccctctttctgggcaccgtctgctgcaacagaaacctgaaatcgtcccatcttaaaaacaccagctcctgaactagttgctaggacagggccttctttgacttgagaaacacccttctgaggctgtgttcctgcttctgtgattgctgttggagccgccatggacacaggaccaaccgcagaagtcactgtgatcatctctggactaagtgttcttctcaattgagcatcaagatcctctagaggttgctgggactgggttagagaaggtcctggaaaaggtggcagctgctcgctgggtagagtacctgctggaagttcagtacccactggcagcaccggagccttagttagaggtggcttggagggagcagttccaggtttcactcctgatgtagtagtgctgactggggtagaaacttgcccaggtgtgaccactggtgtaactggcaaagcaactgttcctagtggtaaattggttggtggtaagcaagtacttgtggtagaagtcaggagtttgcttggtgcaacagcagtagttgggatgcctggtgtgacagtgctctctatgactagtgaggtctccagtgagacagaggcatgctgagctccagatgagctgtgttcactgaacagagaccgcagcttttcttctagagtctttatgtcatcaattccaggagctttgggttgtgtatcagaatctacttcaggacaatgagtatggggctggttgggaagcaaagctggttgaggctgactatgaattagtgtctgctgtacagcaggcacattggcaacaggctgtaccaagggtgggatactaggtacttggggtaataaaggtgtagaagtaggtcctgctgcttggggaagaataggagtagaagctatcactgatggaatgaccaaaggatgcagcccaccaggctgagaaatataactagacactcctgctccaggagaggaagaggaagatggtgcagagagggagaaagccaatccagttgtactgctatgagatgtcttatctagtgagtgtgcgctaactaccacggtttcagctaaagtaggagtagaagtactgctgctaagctgaatggacagctgtgaagctgtgcttgggaatgaagtggtggtagaaactgatgttaatgtggctcccacagtagtgctgcctgctgcctgctgagatactacagctggaggcttaggacctggggtagcagtactgccccctgcagaggctgaagttgctgaaactgttactgaaggatacagtgctgtactagaaacaacgatctcagatgtggatgtggggacttgaagtgacggggatgtagtagatattgagacaactgcaggtattgtgatacttgaaactacgctggaaagtactggtgattcagacacaggtggtatggggagaccacctgaagttaccacacctgtgctggtggcaactccagcaatcccctcttcagtgggcactgtaacctcagactgaattactgatgtggaaatgtcattaggagggctgcttgttgcagggactggtgctgtggctgctgctgtggttgggactccagcaatgctacttaagaaaggaggtactactggaaatgttggtcctgtatgactaaagtttggaggtgctgtattgggtccttctgtcatttgggcacgtctaagttcagaaaaggcctgttgtagactaagggatgatgcagagtgagacaagttcattccagggctctgagctgtagaggcagcaactgtatctgttatttcactggggaaaacttttgattctcgtaatcggctttctggcacaggactcactataaaccgccttcccgcagaatgaacaacttgagttaaagaactggtaggaatgcctatttgctgtggcatggaagacgcaggaattggttgtttgaactctccttccaatttctgagaacctgaaaagccatagtcatcctttccttgtagactctccaatccctgatcaccctctggttccacactgacatcctcactgagcatttcatcagctttttcaataatttctcgcacttgatccacaaacgactctctctctattgctagaataaagtcattgttcaccataattgttgctatctcctcggggttgtcaccatctaggtcaaatttgaatgtaaccattttcctattatgagtctctaattgacattctactactcggtctcctttatttgaaacattcaaaattcttaattttgggcgtgaagttttttcatgtcgagagcgactccttacagattttcggtaatgccgttttgtagttcttccttcatgccttccactggaagatgggacgttctcattgccatcactcatacctgaagcaacatctgaatgtgcactgtctacagaggaagccaaagtggtcggctgggtagcttggggctgtgctactgcaactggctctgcaggagcaacctgagagactccctgagtactctccaaaactgcttgctgggaggatgtagtgggggcttgtgctaaactccctcctggctgggacacttgaacctgtcctcctacaccacccataggaactaaaagatttgattccacataaggctgcaccactgtgggaaagtacccaggtgtagccagtacttctgtcggcatgggaggggataggactgtagaatggatgcaaacagaagccacgttggaagagggagcaatatttgaatctcctgggtactgtggtggcagtcgaggtgggaagccctgtgacagaaatgaggaaggtgagttagagcaggttgggggtcaataaattagcaaaacagcaagacatgcaaaaaaaaaaaaaagaagcacacagcaaagaagaatagtagccaatctctttctaataatctaaagggcatataaagaccacattcttgaaatgaagtagtagactggttccaacagaagagacaggactctacaatactactttattgtcggttatcttcacctagagatgatttaaataggaggaacacaatttcttcctagccaatcttaaatggaaaaatgcaaaaattcttccacataacagtcatatcatgaaatgctaattttcccagtctaaaccccgaagctttttgttgataccatgttggctattctatttattctacccatatatgtaaaagttgccaggtgtactattaaccacatctagcattcaatcagcttacagtgaatactgagagaaccatttttctctgaagaagtgtcttgagaaaa

SEQ ID NO: 3607 - DNA, 1179 bp, Homo sapiens
tttttaggttttatcaacaaagttcactttatttcttgtaacgtaatgttaccaatagtctctaagatgattccaagaagcacaaatatagagaatcctatatctcataagtacaatggatcacctcctgagttcaagctatgaatttcttaaggtttatatcacttaaaactctgacagagccaggattctaaataaaaggaatgtcagaaagccagtcaggctccaaggtacacctgaaacatacctatcacactcttggcaaaagaagcccgcttcagggttgccagaccgaggtctccaatcttgactgagccagtagggccggtgataaaagatgttgtcacatttaaagatccgcggtgaatgataggtgggagttcgagtatgaagaaactgaagacctttaaaggatctgacggcaccagcttcttagaaccttgatcttcatcactttaaaccttttcagatacgttttaagtgttccagacgtcataagttcagtcaccaaaacaatgcacttctttccttttactgtggattcccaggaatcataaaatctaacaatattgggatgctgaagaccttttaacatttcagcttcttctttaaatctctgcctctcagactttgttaattttcgatcctgcagttcacaccaggcgacttccacggtggtttcagtgtccagacctttgtagaccgtcttaaaggagcctctgccgatttcgatgtcaaacttgagaaagcggccatcgttagacattcccacggccttggtctccagctcttcgatatcatcctgctgctggctccgttcctcctgtggctcctttggcgctgccgccgccgctgccacttcctgccggcggcggctcctctttgctccccacaaggctaggctgggacactgggcggtctttgctggtactgctggggacagtcgagggggcagggcccgcgacggcctgttccccaggggcggcagcggctggaggctgctgggctacctgggaagtggcggtggcggtcacggtctcttcccggtggggctccggtggagcactctgcgggacagccgcggggatgctgggctggggcagggaaagaggaaggccgggaagctccagtgcagtggcattggagtcgcagatgacgctccggcggaagaagcggtgc

SEQ ID NO: 3608 - DNA, 3096 bp, Homo sapiens
  misc_feature (1)...(3096): n = A,T,C or G
aataaacaaaaggataangtgcctgcaagaaggctcccacngctccctcngggtaataaagtanggtttcaactccttgggtggcccctttcctcaagctactcagccccttgttggttctatccttactctctcccacaagaaatacaagcagagaataaataaatcattttaaagcaggggtggaagcccttgcccttttcctttctaccttttaaaaaccttcagctctcatttgcatatttagggccgtagaccaacttacttacttattaagggaagcagggcccttaaggaatgaacagggtacaggagcctccagcctctttctgtggtagtggtggtggtggtggtgattcccagaatatgccattgacgtgggtaaaaggttggaaatattttcagtttcccaactaagagtcaagaagcaccccaaaattaagagtcctagcttctttctttgtcttcagagataacaaagatcctaaacatagccagttaggacagtatttccggaaagctctgaaaataattaataactacccattacaaggaggcatagcactgaataacactgattggttgcagttattacttacggggagtattatttatttgaaaatgtgaacatattagttgtacttctagaaataaaggtggcacaatagattatgatcctgcaaccatttggacatcataaaggaaatgagtaggaataagtattctttcctagaatgattaattcagatgtggaaagatagatagattaactttccacaaaatgtagtaccccaagctgagaaatgcatggtacatgtgcaacaagaggaaagcaatccaaacagtttttctgagagcaattttctccatctgtgacttttcactatcaggttccccaacttgaaaactagccccccacccccttctctttatgttcagtttcttctaggtcacgtctgttcaagcctagctcaaataagaaaggtttatatgacagtcactggccaggcatcacgtttgtttcctcattctttagtctttgtctttcacccagcacacaccattcttttaagttgtccaattttgttacaacaccccctcctcactattcccgaaacagaactttctgtttttaaccactgatgccaacctaacttcccaccctactcatcttacacctgctctagacaaagttgttgaatgacttaaaaaaatactttttcaatttccctttggcataaccactgctggactgctggggtcacatggacctacgatttccttccacatgccctttattgatctggggtctggtaagttgatgctaatggcagaagcaatagaagtccaaggcactaaaatgtccagcaagcaacactgggaaacagaagtattcaagtacagtaatttatacaattttacattcacatttatttatctaatacaatggaaatacaaaggaaaaagttaaagtgtctcaataagtaaaggacagagctagctttttttggaactttttaaacgtttcatattttactcttaaaactactgttgtccaacaacattttatatatcacagtgtttccacatcaaaactgatggcaaagttacatgtccgcagggaacttaattttttttttttcctaattgctaatgctgcagtcaaagctgctaatatcttttgcttaaagcactaatgacctatcataagaaagagttgcaccccagtaccctggtatttttcactgggttctaaagagcaaagaaaaaataaaaaagagaggggtaaaaaaaagggaggagggcagggtaggagagagcccagtaggtggtttttgtcctgtggttcggattcttgagggagtgagggattcagggcatgtaccaaaagcaagagctccacccactcgaaattacagatgggtttgattttacattgagttctccagcttccttatgaacaagactttcctagccctcatcctcattactgagtatagataaacaggaaagcatggtctgaagctgccccttgacaaaaaagctgttctttccttcctctcccattccaataactggagcgggggagactctccattctgagggctcaatgcagtattaaaaacattcccctctggcaagaaataaccagttaaatgcagcactagtagttagtatataggggggttttcaccccccacccaccccctcagcatttcatctcctgcccccagatccattcaggtaatgtctctaggtctaagtggtccgcaggttggagccctggggggttgctgatggatttctgcaaattgctgatgttgaaattctgcaaggaggcagttcccacaggttggaactgccaaattggtgtgtgctggggcacccgtccactccattgtcgcaaaatgggaactgaagaaagccatactgctgtggggggcacatagacttggtgaagtgacctagagaggtagctgatgctgcagagatgggggcagagacacccgagggttcgaggtcatggagatgcacagttgcccaggtgcagagaacttccttgccattccagggccctcataattcatgtgccctttgcttcctctcctgcctgagagattcatggcatctcgggcccaattgtctaccaacttgtgcaagtcatctgtgaatgtgcccttcctgctggacgtcatggcaggaggctgagcttgggcggcttggctgttcactgttgccccaacagtgtttgtgctgctggttccttgacctggagcagaaaggcttggtactgaaatggcaccatcactggtgaaggctgaatagaggttgtcactggagggagatggcttaaggggctgtaacagctgattctgcccggactctgggatgttgccaggagggtggagggtctgctgggggtgcaagactgaagctgcactctgaccagacaggttacctgaaagctgggggcttttattccccaaggaactgcttcgactagatttgctgcctttgcttttagtgggtcgtcgtccttctccctgaaaggggagcagctgggggaataataacagcagggcaccttgcccagtt

SEQ ID NO: 3609 - DNA, 1345 bp, Homo sapiens
  misc_feature (1)...(1345): n = A,T,C or G
tttttttttcatgtcgagagcgactccttacagattttcggtaatgccgttttgtagttcttccttcatgccttccactggaagatgggacgttctcattgccatcactcatacctgaagcaacatctgaatgtgcactgtctacagaggaagccaaagtgctcggcgtgggtagcttggggctgtgctactgcaactggctctgcaggagcaacctgagagactccctgagtactctgttttccagctgatacttgaggcaagacttgtggagcttgaggttgactcactggctgtgcagttagtggcctcactggaggttgatgtctgtgaaagtgaatactgcactgtctgttgaggaggggctgtctgctgtattccctgcacacttgagggtggatataccccatgggcctgagactgtgcttggacagtagaaggtatatgccctgggactgtgcctgtagaatgtgccctgttcatgttgggaacccatatgaaactgtctgttggctgctcactcgagattctgtgaagacagaggatcccctgaccactgtcaaccgtcccatcagataacacagatatactgggttgctggtactgtagttgttgatgttgatctgcctcaggttcttcaggttctacttgtgtagaaactgaagctgaagtggtagaagcagtaggtatgccggtgctagcagaagggagctgcttgattcctgtctgggaagcactggattgttctacctgctgtttgagactgctctcttcctgcttttttttttcttgctcctcccgtaccaactgccgctgctctcgtttcctcttaattaatgatactctgtctttgatagctttagccatggtcttgtgatcaccttcacagacatacccagactctaccatttcttgtgcaacatcttctgggacatctctctctaaatcaaaagaaaactcaatagcttcattatctttgtattttccctttaatttcttaatatcttcaatacgtagccataattttatggctattttttctccatcatcttcttctgctaattctacccgtactcctgtttcctcttggaagaaggcatggttcaaaaggtctttgatggaatatctttcatctttgttttgtcgtatgcatccttcaataatttccttcacttcaggaattgctactttgtcaaaactggctggcttcaccccctcatttatacaatccttttgagggcagcagcagcaatgagaatttatgatgacaaatactgagcaaaaatctttctttctaatatccatcaganaaggcaaaacagatttcttattggaggaaaatgaa

SEQ ID NO: 3610 - DNA, 647 bp, Homo sapiens
  misc_feature (1)...(647): n = A,T,C or G
ctcntnaagtctatgngagaatgttgagagtgannanntctcatgtggatagtgantcttnanagttttcnggtaatgacggnttgtngnncttctttcatgacttccnctnngaggtgctnnnatctnanancccacattnatgcccgangaacaatctgaccgtgcactgnctncagaggnagncaaagcggtcggttggttaggttggngntntgctactgnaantgnntctgcaggagnaacctganagactccctgagtactctccaaanntgtttgctggnaggatgtagtggaggcttgtnctatnctccctcctggttgngacacttgancctgtcctcctacaccacccanaggaactaaaagatttgatnccacataaggctgcaccactgtgggaaagtacccaggtgtagncagtacttctgtcggnatgggaggggataggactgtagattggatgcaaacagaagccangttggggagagggagcaatatttgaatctcctgggtactgnngggggaagtcgatgnggnaagncctgntttccagattgatattggaggaagacttgtgggggttgaggttgattcantgnttgngaaggngggggcccaattgaggttgttgtttncgaann

SEQ ID NO: 3611 - DNA, 542 bp, Homo sapiens
  misc_feature (1)...(542): n = A,T,C or G
gctcctcccgtaccaactgncgntgctctcgtttcctcttaattaatgatactctgtctttgatagctttagcatggtcttgtgatcaccttcacagacatacccagactctaccatttcttgtgcaacatcttctgggacatctctctctaaatcaaaagaaaactcaatagcttcattatctttgtattttccctttaatttcttaatatcttcaatacgtagccataattttatggctattttttctccatcatcttcttctgctaattctacccgtactcctgtttcctcttggaagaaggcatggttcaaaaggtctttgatggaatatctttcatctttgntttgtcgtatgcatccttcaataatttccttcacttcaggaattgctactttggtcaaaactgggctgggcttcaccccactgggtcacgcgacgggagatctgcgcanaatttttgggcactccgagtaaggataatcagatggtagccatctcaagcatgcacatcccaaagcataacggcacggatcatcat

SEQ ID NO: 3612 - DNA, 515 bp, Homo sapiens
gcggccgcctttccggcgaccccagtttcccaggacgaagggcactccgcaccggaccccggtcccggcgcgcggcggggcacgccgcctcccgcgccgcggggcgcgtggcagggcgggggcacagtagactgtggtgaagtgacctagagaggtagctgatgctgcagagatgggggcagagcacctcagggttcgaggtcatggagatgcacagttgcccaggtgcagagaacttccttgccattccagggccctcataattcatgtgccctttgcttcctctcctgcctgagagattcatggcatctcgggcccaattgtctaccaacttgtgcaagtcatctgtgaatgtgcccttcctgctggacgtcatggcaggaggctgagcttgggcggcttggctgttcactgttgccccaacagtgtttgtgctgctggttccccgattataagcaacagaatacgagcattaaaagaagcctaggttacaatttcaggaagagggaaaactt

SEQ ID NO: 3613 - DNA, 839 bp, Homo sapiens
  misc_feature (1)...(839): n = A,T,C or G
cccngtggggccaaggggtaccaaaccccccaanncnattncngaagaaaaanaaaccggnaanatgggttggaaactgccccnttnccnaaaaacttgnnntngccntnccgnnnncaaanccaaataactggaaggggggagactccncaaatcctggggctccaatnaagnaatanaaaaatcccccncctgncaagaananccangtnaaatccanccccnaagtagttaagaaaatagncaactttacnacccccacccaccccctcaancatnccatctnctccccccagatctagtcagttaatgtctctaggtctaagtggtcccncaggntggaccctggggggttgctgatggatttctccaaattgctgatgttgaaattctncaaggaggcagttcccacaggttggaactggccaagtgnctgtggtgctgggccacccgtcccactccattgancgccaaatggggtagctggaaanccatactactgtggggggcacatagacttggtgaagtgacctagagaggtanctgatgctgcagagatggggncagagccacccaggttcgaggtcatggagatgcacagttgcccaggtgcagagaacttccttgccattccagggccctcataattcatgtgccctttgcttcctctcctgcctgagagattcatggcatctcgggcccaattgtctaccaacttgtgcaagtcatctgtgaatgtgcccttcctgctggacgtcatggcaggaggctgagcntggacgncttgnctgttcactggtgccccaacataatggcangncatcaaaggaggggggggg

SEQ ID NO: 3614 - DNA, 717 bp, Homo sapiens
  misc_feature (1)...(717): n = A,T,C or G
tttttatttttatttttaacagtgtacattgttaaataatgtaaggaaaacatttataattcagaaagtttttaatgtggaaaaagatactcaaagtgtactattaacacaaaaataatttaaacagttcagtagcactagttcattcctctaggcttgttatttcatacacaggaggatgaaatcaacagtaagtaacaccagttctgactttttttgtgtatgagtgaaaagatgtcaaaattattattaaacccaaataacaaatgataatgtgctgcatgaggctccactgctcctctggtataaagtatgtttcactcttggagatgcacagttgcccaggtgcagagaacttccttgccattccagggccctcataattcatgtgccctttgcttcctctcctgcctgagagattcatggcatctcgggcccaattgtctaccaacttgtgcaagtcatctgtgaatgtgcccttcctgctggacgtcatggcaggaggctgagcttgngcggcttggctgttcactgttgccccaacagtgtttgtgctgctggttccttgacctggagcagaaaggctttgtactgaaatggcaccatcactggtgaaggctgaatagagttgtcactggagggagatggcttaaggggctgtaacagctgattctgcccnggactctggatgttgccaagagggtggaggtctgcctg

SEQ ID NO: 3615 - DNA, 492 bp, Homo sapiens
  misc_feature (1)...(492): n = A,T,C or G
acaattttacattcacatttatttatctaatacaatggaaatacaaaggaaaaagttaaagtgtctcaataagtaaaggacagagctagctttttttggaactttttaaacgtttcatattttactcttaaaactactgttgtccaacaacattttatatatcacagtgtttccacatcaaaactgatggcaaagttacatgtccgcagggaacttaattttttttttttcctaattgctaatgctgcagtcaaagctgctaatatcttttgcttaaagcactaatgacctatcataagaaagagttgcaccccagtaccctggtatttttcactgggttctanaagagccnannaannaagggnaaaaaaaannaannaacttaactaaaaagagaggggtaaaaaaaaggaggaggcagggtaggagagagcccagtaggtggnttttgtcctgtggttcggattcttgagggagtgagggattcagggc

SEQ ID NO: 3616 - DNA, 454 bp, Homo sapiens
  misc_feature (1)...(454): n = A,T,C or G
tcttaatatcttcaatacgtagccataattttatggntattttttctccatcatcttcttctgctaattctacccgtactcctgtttcctcttggaagaaggcatggttcaaaaggtctttgatggaatatctttcatctttgttttgtcgtatgcatccttcaataatttccttcacttcaggaattgctactttgtcaaaactggctggcttcaccccactggtcacgcgacggtagatctgcgcagatttttggccactccgagtaaggatattcagatgtagccatctcaagcatgcacatcccaaaaagcataaacgtcaacgggattcatcatatttctcctcatacatctcagggggccatgaactctgggggtacctaatcacactcttgggcaaaagaagcccgcttcaggggttgccagaaccgagggntccaatccttggact

SEQ ID NO: 3617 - DNA, 412 bp, Homo sapiens
  misc_feature (1)...(412): n = A,T,C or G
gggatgctgaagacctttaaccattcaagcttcttctttaaatctctgcctctcagactttgttaattttcgatcctgcagttcacacaggcgnacttcacggtgggtttcagtgtccagacctttgtagaccgtcttaaaggagcctctgccgatttcgatgtcaaacttgagaaagcggccatcgttagacattcccacggccttggtctccagctcttcgatatcatcctgcggctggaggctgctgggctacctgggaagtggcggtggcggtcacggtctcttcccggtggggctccggtggagcactctgcgggacagccgcggggatgctgggctggggcagggaaagaggaaggccgggaagctccagtgcagtggcattggagtcgcagatgacgctccggcg

SEQ ID NO: 3618 - DNA, 218 bp, Homo sapiens
ttttttttttttttttttttttgatttaataaagttttatttttccaaatgtccagctggttgggaagcaaagctggttgaggctgactatgaattagggtctgctgtacagcaggcccattggcaacaggctgtaccaagggggggatactaggtacttggggtaataaaggggtaaaagtaggtcctgctgcttggggaaaaataggagtagaagc

SEQ ID NO: 3619 - DNA, 211 bp, Homo sapiens
  misc_feature (1)...(211): n = A,T,C or G
taaaaactaatgtggtcccaacaacatttatatatcacagtgtttccacatcaaaactgatggcaaagttacatgtcngcagggaacgttattgttttccctaattgctaatgctgcagtcaaagctgctaatatcttttgcttaaagcatctctctctctctctctctctctctctctctctctctctctctctctctctctctntctct

SEQ ID NO: 3620 - DNA, 1271 bp, Homo sapiens
tttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtcgggccctcttgcagcccctgggtgagggtgtctctgtgaggctccactgcggtctgtgcctgactggccacatctaactctctgtttccaatttcagaatcctaactgttgcataaaatacattgtttgtcctgcgagaatattttccgtcctccaccatcaacattgacactgcgtagatttgccgcacttggacctccatgcgtggcactcacccgcagtctcctggacaggcgctgtattttattctgtcgcagagctaatgctgtttactcactcacttcaacaacactaactgcggtggtggcctccagcaggcccccccgctgcagaccctctgtcctgcctctgcctccaggatgcgtttccccgtgaggccaatgcacctccccccacctcccaccctcccatgtccacagtgggtcgtgtgttcctggacagagaaacagtccacactggggcctgcgggacacatatagcagcatattttgctcttaaccccacccacctttttaatcacactagattttaagatcaatccctttttgaaacaactcacggagaaaaccagaacataaatggcctcctgccagctccggcgtctctctgtggtctgccttagtgggccaagtccaaatgcagagaaggcctttcccttccgcgcctgccccatcgggctcgctgacgaggaagcgctgtccctgtgatgaggttctctctcagagagtcttggaaaagagaccacttgctcttgtttaaaataaatttggacgtgatttttccatgcagcatctggtgtgaataaaacagcagttgactgataaaaaaaaaaaaaaaaaaaaaaa

SEQ ID NO: 3621 - DNA, 185 bp, Homo sapiens
ggaatctcagggcctctcgcagcccctgggtgagggtgtctctgtgaggctccactgcggtctgtgcctgactggccacatctaactctctgtttccaatttcagaatcctaactgttgcataaaataaaaaaaaaaaaaaaaaaaaaaaaaaaaaaaaaaaaaaaaaaaaaaaaaaaaaaaaaa

SEQ ID NO: 3622 - DNA, 638 bp, Homo sapiens
ttttaactagcaggcatccaattttcattttatttctttttaccttcataatagttattcataccacctttccaacaagaggtttactggaagtacagtcaatgaaatcatttactattactattgtataagtcaatatttgctttcagaaaattatttctaaggttttaaaatatttttccaacacaaatgcccttaaaacaatgcaattaaaaaaataaaaaaacttaaggagaaaatatttgcaaatcatgtatccaataaggagcttgtatctagaatatataaagaacacttacaactgagtaacaagacaagtgtactttaaaatgagcaaaggaactattataaataggcatttctgaaaaatgtacagtaaacggccaattagcacatgaaaagatgtataacatcattagtcatcaaggaaatccaaatcaaaaccacaatgagatacataccacttcatacccattgggatggctagaatcagaaagtaagataagtgctgatgagaatgtggagagactggaatcttcatacacacaaaagggaatgtaaaatgatctagccagtttgaaaacagtatggcagttccccaaaggattgaacacagaggttatgcatgactcggcaat

SEQ ID NO: 3623 - DNA, 500 bp, Homo sapiens
tttttttttttttttttttttttgccaaaccatttttttttaatgttcgtttttggaaatccaaaaacaaatggatttttgagggatcagggaaccactgatttaaaatcttgtgctccaacatagattctttgatgtttagtatatttcacacaacattgctgaaggtatttcttaaatgtgttttgcagtgtctaataagggatgaactacagctgaaggcttttccacactcattacaatcataaggtttttctccagtatgaattctctgatgtttagcaaaggatgaatcatgcctaaaggctttcccacaatgactgcattcataaggttttactccagtatggactctctgatggatagaaagatgtattctctggctaaaggctttcccacattccttacatttatatggtctttctccagtatgagttctctggtgttgagttaggtatgtactatggctgaaggttttactacatacattacaaatatag

SEQ ID NO: 3624 - DNA, 664 bp, Homo sapiens
ttttagtatttattgatcattcttgggtgtttctcggagagggggatttggcagggtcataggacaatagtggagggaaggtcagcagataaacatgtgaacaaaggtctctggttttcctaggcagagggccctgctgccttccgcagtgtttgtgcccctgggtacttgagattagggagtggtgatgactcttaaccagcatgctgccttcaagcatctgtttaacaaaacacatcttgcaccgcccttaatccatttaaccctgagtggacacagcacatgtttcagagagcacggggttgggggtaaggttatagattaacagcatcccaaggcagaagaatttttcttagtacagaacaaaatggagtctcccatgtctacttctttctacacagacacagcaacaatccgatttctctatcttttccccacatttcccacttttctatttgacaaaaccgccatcgtcatcatggcccgttctcaatgagctgttggaaaggggtggccgatgcattcacactgacattcacaccatgctgcttggaagaggtaggagccacagggaacacagcaggcccatacttggaggtgaatcagatttcactgcagagcctgtagcaccttctacaagattgtgtggctgtaactgcgtgcc

SEQ ID NO: 3625 - DNA, 231 bp, Homo sapiens
  misc_feature (1)...(231): n = A,T,C or G
ctggcttggtcttcccccgtaaggaaatggccggggagctccaggggacccaggcgccgtcgcttcggcggagctgggctgaccagccaggacagcggggtaaaccngaacaattctncgcgaggtgtttgtactgctatttatttttntnaagaggcaaatcatgcgctttgcaatgaaatctcgaaggggacctcatgtccctttgggacacaatgcccccaaggactt

SEQ ID NO: 3626 - DNA, 3244 bp, Homo sapiens
ttgttttgtatattaccaatttattaataaattaacgttataccattttccctgaaagcaaaagtatttttccacctctgctcggtgaaaattaagaaattatgtgtaagaacagcatttagcaaatagctattaaaaaaagagagaccaattttctaggtgcattgggacatccatttaaaatcaatacaaaaaataactccttgtaaatatataatatatatttatacataatttgaatatatttacatacatccagcacctatatactgcatttgtgctctgtaagtgtgtgctgacataaatcttctccaattattacaaaattaacaaggaaggcagaacgcacgtccaccttgagtcctactggtccacagccagaacgcacggcaggtgagaggggttacatggtggcttgtggcagtccactgctccagaaaccttcttctcctcctggggaagattacaagttttcaactgtataaatctttacacatatgctgattacttttccaattatttactcctctgatccatatatacaagtggagacaacaagctctgggaggcatggtctccctgctcagtgtagctaggttcccagtgctgtcctgtttggggacaggcagacacagtcattcatgttttaacactgccgtttatgtgtggatactgaggaaggcatggttcgtaaggcatggggtctggagaaaaaacagaatcatctcctgaagaacaagaacttcttgtgtcagggtaactaggtgaatactgttcgagaggttggctgaggtccaagtattcctcattggttgtgagagtgagaattcgatccaagtcttctaccaactgcttgaacgttggtctctgggagggcactgcatgccaacagtccctcatcatcatgtacagttcgttggtgcagttggctggcttatccattctgtgtccttccttcagcagcttaaaaagttcctccacgggaatccctgggtagggcgagccccctaaagtgaagatctcccacattaacaccccgaaggaccagacatcactctgatgagtgtatactctatcaaacagggcttctggagccatccacttgactggaagccgcccattggtggtctttttgtaatagtctatattgttgatatctctggcgagtccaaagtctgctattttcatcacattgttttctgttaccaaaacatttctggctgctaaatctcgatgaatacatttttgggaagccaagtactccatgcctctggccagctggtaggtgcatgacaccaagtccttgaaggtcatctgctcctcaggaacacggttaatgtcataggagtactccatcccgggtggcctccgggctcggaggtattctcggaggttgcctttagaggcatactcaactatgacatagagaggcccatcctgtgtgcaggctccaagaagatttatgatattcttgtgtttcccaatcatcttcatcatctccatctctgacaccagatcagaaaggtctttctctgtggcatcatctttcaacatcttcacggccacggtgaccgcctccttgggcttgtctttgtcaattcccactgcttccgccatgaccacttgcccaaagcaaccttctcccaggggcttgcccagtgtcagcttatctcttggaaactcccattttgggtcctctggaagttcatactcggagacccctgccagcatgggggtgtctgccgttgaagagaggcgtgttgttatcctcaccagcggggtgttggagttcatggaggagctggactcagccgaaaccttgagaaccttgaggtagggcagcccgtcgggcccgtatttactgccgttcttttccacgtgcttgatccactggatgtggggctgggcatcactgtaaaccttgcagacaaactctacgtctcctccgaccactgtggaggcatttgccggcagtccggcttggaggatgggccggtgaggcgatcgctccacaacatccaggtggtacgtgtgattgatggacccgtattcattctccaccacacaggtataatttcccttgtcagatgggaccacactttccataatgaggctccagtgctggtttcgtaccttgtagcctccaatgcgatgctcctgcttaaactccttcccgtttttcagccaccgcatggttggcattgggttccccccggctgggcagcgaaacttgacagtgttggccgcaggcacagcatggagccgcttttccatcttttctgtgttggtccagtatggtgctctcttgttgttactgttctcactgacaaaatcttccgcaccatcggtgtcatcctcatcatctccggatgagatggcatctgtgacattcaccatgaagtaccaagtttcactgtctacagtcctactggcagtacaagcatagaggccggagtctctaggcgtggcgccctttatctgcaagtactccccaataagcactgtcctattgttgggccccaagtgcaccccatccttagtccaactgatcacggcggcatctttcaacaggcagcgcacctctagcgactcccctggcgcagccacgtacacttctggttgagagatttggtatttggttggtggctcttctggctctaatgtggtatcctcaactaaactgaaggagggccgggccagggacaaggttgccatggtgaccacgaccaggcagatgaaacgaccccagctgaccatggttacggtaccaatccccggtcctcttccatatctccatgtggacgttaatcccatctgcacacttcctctacgggcatggactacgcgcaatgccttcagcctgcggtgggctcaggaaccgaggcgctgccgctgctgctgcagtcacttgaatggcaacgctcctccgcgacctgtgttgtccccgcgccccgcgtgggtcgggatggagaaagcgacgagcccggggttggggggagcaactccaaacgcagaagagtggtccttgggtcttcgccggcgccaagcctcccgggcttcacgcgtaccccaggctgcggaggagcgcgggcatgacgcccgcgggctgccctcggatttggggaacgagaggaagaaaggactcaggcttggcgttgcctccaccaaactttgctcgcgagttgcgaaggctcagagcgcgcaggcaagctgcggcctcggggcccccggggctcgcggccgg

SEQ ID NO: 3627 - DNA, 326 bp, Homo sapiens
  misc_feature (1)...(326): n = A,T,C or G
aagttgcgtgacatttattttgtcttgttaacattaatatctgtagaaacatttttattgtcagtataaaaattaacaggttttattaaatacnttctccaattttgtaacacataagatcagtgtaatctgcattcatcttgcacggctattgcaaagtgagtgggtgtttccaaagcaaaacacaatactttagtacagaaggaacaacggcgatattttgtctgccgttgaagagaggcgtgttgttatcctcaccagcggggtgttggagttcatggaggagctggactcagccgaaacctgtctccgcanggggataccgt

SEQ ID NO: 3628 - DNA, 434 bp, Homo sapiens
gtcagggggaagctggaaggcgtcgttctcctttcccagctctcctgcctgtccggcatgttttcaggccgggtctggcttggtcttcccccgtaagaaatggccggggagctccaggggacccaggcgccgtcgcttcggggacatgggtctgaccagccaggacagcggggtaaacccgaacaattctgcgcgaggacttgaaagaggagattgatattcgactctccagggttcaggatatcaagtatgagccccagctccttgcagatgatgatgctagactactacaactggaaacccagggaaatcaaagttgctacaactatctgtataggatgaaagctctggatgccattcgtacctctgagatcccatttcattctgaaggccggcatccccgttccttaatgggcaagaatttccgctcctac

SEQ ID NO: 3629 - DNA, 289 bp, Homo sapiens
  misc_feature (1)...(289): n = A,T,C or G
ttggtcttcccccgtaaggaaatggccggggagctccagggganccaggcgccgtcgcttcggcgganctggngctgaccagccaggncagcggggtaancccgaacaattctncgcgaggtagggaggccatggcgtccggcagtaactggctctccggggtgaatgtngtgctggtgatggcctacgggagcctggttgctacaactatctgtataggatgaaagctctggatgccattngtacctctnagatcccatttcattctgaaggccggcatccccgttcc

SEQ ID NO: 3630 - DNA, 507 bp, Homo sapiens
  misc_feature (1)...(507): n = A,T,C or G
aacctgggtccccccaggggaatacgttttgtcagctttgtgcacagcccggctggctgctgaagtctggcttcttggtcgtgttcttcattcggcacagaaatgactgttaccaccataccaggcgattaagaagaccccntatgcagtaaatggctatctccaggtagtctggggaagctgtaatctccttttctcttccaggcgcttgctgttttggcaggacagtgagccaggcagactggttggcctgccctatataattggagaccttacatatatattccccagcatccgcctcggtcacattgaacagagccagcacttgggtcttcgccggcgccaaactttgctcgcgagttgcgaaggctcagagcgcgcaggcaagctgcggcctcggggcccccggggctcgcggccggcccccgccagcccggagagcagtcgccgcgccgggccaggtacgccgcatgcagccccgcggcgcccgagctttgtggcggccgc

SEQ ID NO: 3631 - DNA, 414 bp, Homo sapiens
ttttagctaaagaaataccacagtttattgaagactacaaatatttttgttacaagttgaaactacatgccttccagaaatcaaaagcaacagcaggtgtgtgcattgatgcttcgaaggtgctgcaccgcttgaacttgaaatgggtaagacagggtcagacacatgggggagagggaaatgggggaggggcaagttcaaaagcccagaaggtatccaccaactcatttccccaagccacgcaggccatggcctcagctcagcatcattatggtccgaaatcatctgtgcaagtctaatttgttctgcagtggcctgtggccgctgcttgtgctgagtctggatttggttttgaggttgttcccagtttccccgggctcggatagtgcccaccgatgtcatcatttacagtat

SEQ ID NO: 3632 - DNA, 410 bp, Homo sapiens
ccccagaacaaggctcaaatgcggacttggacacacttcgaaggagggctgtctgcccctgctgttcgggcgtggggggtggggggcgggggccactgagctgggccttctgtcctcctccctggatgtgcagacatgggccatgcttctgccaggactcacatgtcctcctcactgaacaccagagacacctgctaacttgggaagacgcagggtgaggatttctgtttctccagcccagcctgtcaccctgtgggaagcagcgagtgggaagggaaaggggaagtcacatgtttctcacgccgagttccttccagaatcccaaagaaggctcagaaggttgtgaaggaagaacaaagtcagctcaggtgagacaccccttccccaccatctacactgtgacacaccca

SEQ ID NO: 3633 - DNA, 823 bp, Homo sapiens
  misc_feature (1)...(823): n = A,T,C or G
gctcatacttgatatcctgaaccctggagagtcgaatatcaatctcctctttcaagtccttgggggcattgtgtcccacagggnacatgaggtccccttcgagatttcattgcaaagcgcatgatttgcctcttcacaaaaataaatagnagtacaaacaccaggctcccgtaggcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtaagggaaggccatggcgtccggcagtaactggctctccggggtgaatgtcgtgctggtgatggcctacgggagcctggtgaggagattaccccaccccattcctgctgtcgcatcttacccagtagagaccctccttttgagctgtaccccgtctgcattctccacccactcacctgcgcctatccgggctttgactcctttattccaggagtaggtgggagtttaagtcacttagtcgggccgacccgccctcgttagtctagaaccctccctttaacgctagagcacagaccccacgcctccctgctgctggcttcttagatccacccccatcataacggccttgctttgccccaagttttaccctgaaacattcctgagagccggaatctggggatttggaatgaaggcatgcttttttaaaaaaaaaaacaaaacaaaactgactttttattaaaggatttttacatcttta

SEQ ID NO: 3634 - DNA, 556 bp, Homo sapiens
tttttttaaatccatttttgtggtttccaggagttggttatttagaaatacaatcttactcctgctgacatcatcacaccaagacctttgtggctaagggtcataaaaagaaaatgttaatccaatatccccatttatagctgagtctccatcctgggacatggcccaagagaagtactcacttatctcttggaaactccccattttgggttcctctggaagttcatactcggagacccctgcccagcatgggggtgtctgccgttgaagagaggcgtgttgttatcctcaccagcggggtgttggagttcatggaggagctggactcagccgaaacctggatacaaaatgcaaagacacagatgtaatcctgggctccatctgagaaggctggaagtcagccagagcccagcccagagtatcgaatcttagaaaggaatggggttggggggctgggcagaagtcaagaaaccaaattagaaaaccactggaatctaactcctctgccctccagtccatgcagtaccagatttcatccaaatttctctgtgccgaa

SEQ ID NO: 3635 - DNA, 508 bp, Homo sapiens
gtgagtcaaggttgtagctttactgcgactcaggagcagtgaggccaagccaggtgtggggctgggccccagaacaaggctcaaatgcggacttggacacaaggggtggagctgatggacaagctacccaagaagaaagcaggtaatgtgggtgtttctgggagggaactccatttgtccaggccgaacctctgaaagaagctcttcttcatatccaggctatagattctgaagtttttcaggggtgaatcattcagatagagatttccaattaagcctttgcgctggtcatcaatattctccccatagttgactcgcccacgattctccaccaagatcctcagcacggtgtaaccctggatcagggggacagcaatcttcgttgtcttgtagtccaagaatcctatggatactgtgttcacaaacacctgcccccgatcatgcacgtggccactgaggatgccagacgaggtgatgctggtctcatagagaatgtacccgaaggact

SEQ ID NO: 3636 - DNA, 625 bp, Homo sapiens
  misc_feature (1)...(625): n = A,T,C or G
ttttttttttttttttttttttttttttttgggcagcaacactggtttattctcaggtttgaaagtcaggaaagtaaacccaggggggaaaggcaagggccgggggacacagcatggcgcaaaaaagtcgacaagaaaacaggtgacaggcagaacttccctccatgctcctttttcggggaccatcggagccgggcagttacttactcttgttgttactgttctcactgacaaaatcttccgcaccatcggtgtcatcctcatcatctccggatgagatggcatctgtgacattcaccatgaagtaccaagtttcactgtctacagtcctactggcagtacaagcatagaggccggagtctctaggcgtggcgccatttatctgcaagtactcgccaataagcactgtcctattgttgggccccaagtgcacgccatccttagtccaactgatcacggcggcatctttcaacaggcagcgcacctctagcgactcccctggcgcagccacgtacacttctggttgagagatttggtatttggttggtggctctctggctctaatggggatactcaactaaaaacttagaggccgnccaagggacaggttgcctgtgacaacgac

SEQ ID NO: 3637 - DNA, 1950 bp, Homo sapiens
  misc_feature (1)...(1950): n = A,T,C or G
tttttttttttttttttttttttccattcctagggggaatgggccccaaggttttgtttttttatttcgtttttggggtacagggggggtttggttacatggatgaattctttaatgatttctgcgactttagcgcacccatcacccgagcagtgtacactgtacccaatatgtagtctttcatccctcaccccactccaaaatttagttctgccaaacgaaacatgttgccttcacttctttttagtttatttgcctggacccatctaagtcaatacttaaaaactcctaanaaagcattttttttcctttgaaaatggtcctcaagctcccttcttgatcctctcccattttcccaccccaatctcctctatccctctccctttactgcctgaaatcggctgtagatgtagcagtttctggaggaaatgaagatttgtggtggttctttccagtcaccaggttgtgaaagtcttaggagtgaggggaaggaaatcccctcaaggacaagatactactaccacattaaggtcaggagttcttaaagggcgaagatttcattttattccactgccttcaggggcctgctagaggaggcccagttggtacagtaatacttattcaccaagctggtcatcgacgaaattgaggatgtcctagacggagcaagaataggcagaggctggaaggtagaggttttctttttatatatacaagacacattaatccattaaatttgaggacacagtacaaaaaaaaaaaaaaaaacaaaaaaaaaaaccacttcaactaattcatctgacaatgctgttcatattcatgacgccatttttttgtttgttgttgttcgttgttttcctaataataaagaaggagacttagggctgttcgggctgatataatatttggggggggggtcaccttcccacctcacccatacaccaccagggtgaacaggaggaaggcaaaggaagtgcacgggcccatagcaaagtttcataatcttgaatgcaagaagggagaaggaatggaagggggaaaaaaaaaggagaaaatacaaatcctataatacatacaacagggtgggggatggtatagggatggggacagacatgaagctgaggcatggggtgggccgctgggggtgggggggcagcggaaaccccccacattcctttctctttgatgctgtttccatagtttccaggcttgagaagccctcttcaggaaggatggggacccgggagaaggaggggtcagggcctcagttggccccccagcatgtagctgttgtaggcagacttgtttgggtctggggcttctgcgggatggagctggtctggctacgttgcccgctgcccgtctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctgggttttggagtacacagaacccgagatatctggcacgcccgtgttactggaggtgactgaaacaccagtgttgtatccatgagacccatatccactcggctgttggaaaggggtggccgatgcattcacactgacattcacaccatgctgcttggaagaggtaggagccacagggaacacagcaggcccatactggaaagtgctggggaggccccggacccctgtatagtatggcaggctggtgtaaactgtagccaggaaggcagcgcggggttcaaggatgtctggctgcgtggtatggtgagtctggatctggttctgatggggttgggcctatgttgtagctggggtttgggagatgcattccgacggcccacctttgtaac

SEQ ID NO: 3638 - DNA, 943 bp, Homo sapiens
  misc_feature (1)...(943): n = A,T,C or G
ttttttttttttttttttttttttttttttttttttttgtgattcaaaggttatagctttactgcaactcaggacaagtgagcccaagccaggtgttgggctgggccccaaaacaaggctcaaatgcggacttggacacacttcgaaggagggctgctctgcccctgctgttcgggcgtggggggtggggaaccggggggccactgagctgggcctttctgtcctcctccctgggatgtgcagagcatgggccagtgcttctgccagggactcacatgtgaacctgggccttctgtcctcctccctggatgtgcagacatgggccatgggtttctagcagggactcacattgtgagctgggccttctgtcctcctccctgggatgtgcagacattgggggccatggctttctgccagggactcacatgtcctcctcactgaacaccagagacaccttgctaaacttgggaagacgcagggtgaggatttctgtttctccagcccagcctgtcaccctgtgggaagcagcgaatgggaaagggaaaaggggaagtccacatgtttctccacgcccgaagttccttcccagaatccccaaagaaggctcagaaggttgtgaaggaagaacaaagtcagctcaggtgagacaccccttccccaccctctacactggtgacacaccccaggatttcggggataaaatggggccatgagggatgtggccaagcctcccaggaaccagcaaagagcacgcctgagtccagcagaatgctcgcaaagcttgtgacgtccggtgcaagggcacgtttcagcactttttctgagggccaaaggctgggcgatctgattagctgctcccaccctagagacagcccgacagcctcggcacaagagcagggctgtaggaaagccntcatcaacaaagccaggcccagagccatcg

SEQ ID NO: 3639 - DNA, 1793 bp, Homo sapiens
  misc_feature (1)...(1793): n = A,T,C or G
gtcacgtgtcagggggaagctggaaggcgtcgttctcctttcccagctctcctgcctgtccgccatgttttcaggccgggtctggcttggtcttcccccgtaaggaaatggccggggagctccaggggatccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgtttgtactgctatttatttttgtgaaaaaggcaaatcatgcgcctttgcaaatgaaaatctccgaagggggacctcaatgtccctgtgggacacaaattgccccccaagggacttgaaagaaggagattgatattccgactcctccagggttcaggatattcaagtattgagccccagctcctttgcagatgatgatgcttagactactacaactgggaaacccaggggaaatcaaagttgctacaactatctgttattagggttgaaagctcttggatgcccattcgtacctcttgagatccccatttcatttctgaaggcccggcattccccgtttccttaatggggcaagaatttccgttcctaccctgctgggatctgcgaaaacacttagtacgccctttcaaagggtgttacgcaaaagcactcattgataccctttttgggatggctatggaaacaagcccgctatggggacaagggggtcttttggccaagaatgaagtacctacgctatcaggaggccctgagtgagctggccactgcggttaaagcacgaattggggagcttttcagcgacattcaccagttcaggcagccaaagaccctaactcagtcccctgaggtctccccaacaaccatccaggtgacatacctcccctccagtcagaagagtaaacgtgccaagcacttccttgaattgaagagctttaaggataactataacacattgggagagtactctgtgacggagctgaaggactcttgccgtaggattaagccagtcagttggcaatgtggcaaggacaggctggtttgccggggccgccctcgggaacatctgggcccaggcagggcccaggactgttattccatccaagtttcccgttgttttccagagttcttaggagcttgtgttctaaaggggtaatttccccaacccttccttatggaggcatttttaggaacattgggcttaaggactattttcccccagtaggcgcttttttctgggattttggcattcgggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgaaataatctgccaggctatgtgacagtaggngggaatggtttcccctnacaagcccaatgcactggtctgactttataaattatttaattaaatgaactattatcaaat

SEQ ID NO: 3640 - DNA, 3479 bp, Homo sapiens
  misc_feature (1)...(3479): n = A,T,C or G
tttttttttttttttttttttttttttttttagctaaagaaataccacagtttattgaagactacaaatatttttgttacaagttgaaactacatgccttccagaaatcaaaagcaacagcaggtgtgtgcattgatgcttcgaaggtgctgcaccgcttgaacttgaaatgggtaagacagggtcaagacacatgggggaagagggaaatgggggaggggccaagttcaaaagcccagaaggtatccaccaaactcattcccccaagccacgcaggccaatggcttcagctcatgcaggctctcctcaagtggctctggtttcttgaaacaagactttcagtgcaaatttatacacacacacaaaacacagcccccagccttgggccaaattaggntctcagccgtccagaaatgcttgtaggggggtgggatatttcttcccagtgttgtattacatgagacccatatccactcggcctgttgaaaagaggtgaccgatgcattgcccactgacattacatccatgctggttgggagagggaggagccgcaggcaaacacaccgagcccatacttggaaggttgcttggggaggccccgggaccccctttatagtatggcagggctttggtgtaactggtacccaggagggcagccgccgggttcacggaatgtctgctgcgtggtatggtgagtctgcggtctggttctgttggggttgggccaaggttgtggccggggctggggaggaggcattccccacggccggaacttttgtgagggtcaccagaataagggttgctggccaggctaccatccctcccagtcagcggagtagtgggtgtgggaaatgggatgctgtagtaatccaatggaaatcttgtctgaagcatctgcaagtcatcataaccatatacttgtggcgggtaggcatgtaacagccctggagccataatatacggattaggcaacaaccggcgggacccccaggagggaggttgggaggagcttttcctgaagtcgtaaccaactgaagcttcgagtcgaggctgtgacagtggagttgctgcctaaggctgaggcccaggctactgcccactattgagactggaggaagacactgaccactgggggaggtgcagagactgtgctggatgtggtggaaaaagtgctggaggaagaatggagattcgcctcactctccacacttgtgtgcaaaagagtggatgtcgaagtgcgcccagaagatgttgatgatgaaagggtattctgctgcgtagataacgtgctgctgtgttgtgtggtggtagtatttggaatctcctcactgtggctcaagccacccaaggaggatgaatgctgattggttgtcgtcagtaaggaagctgcagataccgtttcattgagaggggggatgctagaagtggaaggtgaatcagatttcactgcagagcctgtagcaccttcaacagattgtgtggtctgtaactgcgtggcctgcacagaactgaagccattctttgcctgagtcaggtccttttggggtgatgaagagatggagctggggtaccgccgagtctgtgtggatctctgttcataaagagggccctgagcattattttgggaggtataggttgtcgactgaattgggccgctctgataaccagactcctgactctggttagatgaaattgtagaggatgattcactggccgtgctggtatacaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatcttagaagtcaaggaggcttttttcttctgctgtttcagtttctgctgagccggctgagggctagaggactggttgtctgaagatccaggcgacatctgtggagccgatgtggatttgcttggcagaggagaagacggaggtggaggtgcagctgtggaggtagccactgcaggtgacttctcctgaaggaacacctccatcatggttgaagatggggtaaaagcctggcgctttgtaaaggggctgtgcactgctgaatcacttgggttcttcaaatcatactgcaccagtgatggggattgtgtcgtcgagcccatgtcccaagaggaggtggtggtgcttccagactgagaatgctgagctgccaactgagccagggcttgggcagtcttgaattgctccaagaactgggagcctgtagtactgccgcctttagcttcaccgacatcaccaaatcctttccctaacatgctcaccatactgtgatgagaaaatgtgttccctgaagcaggctgtgatatggcagtctgcttcgaattactgaacaccagaggctgggccagagaaggagcctgagacggatccagattagatgaatcattctccattgtagatggtgtcttccccagcagaacagcaaggtcaattctctgaccagcagtgattgtcacattctccgcaggcagaggcactgaagacacattagaggcagtgaagatcttggtctcagaaagatcttcattccaatcttcagtcccccactcctctgttgcagtcctccatgcactcgtcccatcatctggttcaaagtggccagtgttgttccacgtattgccgctgctattgccatagttatcatcagtattggctggctctgcataatcagctgggttaaaggttcccattccttgagcagaaaaccttcctcctcgcctaccagagccacctctgcctcggccacggccccttctgcctctttctgttcctcttccagaaggccctccactcttggtgccatccaatccattttcctgacctcgaaactctcgtccacggctggcacctctcccccgtcttggtggcccaccacgtcgccgactatagtctctgtcccggtctcgattttctttgccttcctcattggattccgtctggccaccatccttctggcctgagactcccttcttcttcccgaccatctcccaggaatgcgtgtctgggtttccttccagaagaacattgatagctctgttgacatctccattgcagtcatgcaaagcaatcacacattcatcctggttcttgcctgtaatatcaatcaattgtttcaccttctcctcaaagtcagcatcattatggtccgaaatcatctgtgcaagtctaatttgttctgcagtggcctgtggccgctgcttgtgctgtgtctggttttggttttgaggttgttcccagtttccccgggctcggttagtgcccaccgatgtcatcatttacagtatatacaaataacagtatttacaaggtagaatactgcgcctatccgggctttgactccttattccaggagtaggtgggagtttaagtcacttagtcggg

SEQ ID NO: 3641 - DNA, 4367 bp, Homo sapiens
tttttttttttttttttttttttttttaagttgcgggacatttattttgtcttgttaacattaatatttgtagcatacatttttattgtccagtataaatattaacaggttttattaaatactttctccaattttgtaacacataagatcagtgtaatctgcattcatcttgcacggctattgcaaagtgagtgggtgtttccaaagcaaaacacaatactttagtacagaaggaacaacggcgatattttgtctgatgtaggcatgaggctggatcttttgggtgaggtcctgccagaattagatgaaagcaatcccttaaaaagatgggacgtatccccccaaaacctaccagccagaaccaactctgtgtttcaaattttcctatgatggggacttggaggaccctaaccaagggggtctccaaccgccaaaggagtcctggaagccattaccaaaaattccactgaagagaatacaggccaattctggttaatgttgcactcagaagcccaaaggccagctgcccagaagaagaagccacattcctgcctatcatctcaacctaaggtctgtcctcaaaggaatgggatttaggcatcttttaagaagaaccctggcaacatttatccttgggaaagaccccgatagacagctgccgctaacctgtatgtcacgggttgcacacccaaaatgaaacaccttcctatgaatgagttcttttaatatggggcatttaggaggtctaagaacaatcgtctgacagcagcatttaaacacaaataaatcaaaacttcattttccccaaattagtcatatattgtaaatattctcttttcaaaggatctgataactagttaagtccaagcaatagattaactagtctgctgtgctgcctgcatagaaatgccacttaaattacaaaaaaaactataaatgattaattgttttgtatattaccattttattaataaattaaccgttataccattttccctgaaagcaaaagtatttttccacctctgctcggtgaaaattaagaaattatgtgtaagaacagcatttagcaaatagctattaaaaaaagagagaccaattttcctaggtgcattgggacatccattttaaaatcaatacaaaaaataactccttgtaaatatataatatatatttatacataatttgaatatatttacatacatccagcacctatatactgcatttgtgctctgtaaagtgtgtgctgaacataaatcttctccaattattacaaaattaacaaggaaggcagaacgcacgtccaccttgagtcctactggtccacagccagtacgcacggcaggtgagagggggttacatgggtggcttgtgggcagtccactgctccaggaaaccttcttctcctcctggggaagattacaaagtttcaaactgtataaatcctttaccacatatgcctgattactttccccaaattatttactcctctgatcccatgtatacaaagtggagacaacaagctctgggaggcatggtctccctgcctcagtgtagcctaggttcccccagtgcctgtccctgtttgggggacaggcagacacagtcattcatgttttaaaacactgcccgtttatgtgtggatactgaggaaggcatggttcgtaaggcatggggtctggagaaaaaacagaatcatctcctgaagaacaagaacttcttgtgtcagggtaactaggtgaatactgttcgagaggttggctgaggtccaagtattcctcattggttgtgagagtgagaattcgatccaagtcttctaccaactgcttgaacgttggtctctgggagggcactgcaatgcccaacagtcccctcatccatccatgtaacagttcgttggtgcagttggctggcttatcccattctgtgtccttccttcagcagcttaaaaagttcctccaccggaaaatccctgggtagggcgagccccctaaagtgaagatctcccacattaacaccccgaaggaccagacatcactctgatgagtgtatactctatcaaacagggcttctggagccatccacttgactggaagccgcccattggtggtctttttgtaatagtctatattgttgatatctctggcgagtccaaagtctgctattttcatcacattgttttctgttaccaaaacatttctggctgctaaatctcgatgaatacatttttgggaagccaagtactccatgcctctggccagctggtaggtgcatgacaccaagtccttgaaggtcatctgctcctcaggaacacggttaatgtcataggagtactccatcccgggtggcctccgggctcggaggtattctcggaggttgcctttagaggcatactcaactatgacatagagaggcccatcctgtgtgcaggctccaagaagatttatgatattcttgtgtttcccaatcatcttcatcatctccatctctgacaccagatcagaaaggtctttctctgtggcatcatctttcaacatcttcacggccacggtgaccgcctccttgggcttgtctttgtcaattcccactgcttccgccatgaccacttgcccaaagcaaccttctcccaggggcttgcccagtgtcagcttatctcttggaaactcccattttgggtcctctggaagttcatactcggagacccctgccagcatgggggtgtctgccgttgaagagaggcgtgttgttatcctcaccagcggggtgttggagttcatggaggagctggactcagccgaaactgttacctgtctccgcagggggatacgtttggtcagcttgtgcacagccggctggctgctgaagtctggcttcttggtcgtgttcttcattcggcacaggatgactgttaccaccatacaggcgattaagaagacccctatgcagtaaatggctatctccaggtagtctggggaagctgtaatctccttttctcttccaggcgcttggctgttttggcaggacagtgagccaggcagactggttggcctgccctatataattggagaccttacatatatattccccagcgtcctcaaaagttacattccgaatatagagaacctcaatctctttgtccgtggtgttaacaccggcggccttgagaaccttgagaaccttgaggtagggcagcccgtcgggcccgtatttactgccgttcttttccacgtgcttgatccactggatgtggggctgggcatcactgtaaaccttgcagacaaactctacgtctcctccgaccactgtggaggcatttgccggcagtccggcttggaggatgggccggtgaggcgatcgctccacaacatccaggtggtacgtgtgattgatggacccgtattcattctccaccacacaggtataatttcccttgtcagatgggaccacactttccataatgaggctccagtgctggtttcgtaccttgtagcctccaatgcgatgctcctgcttaaactccttcccgtttttcagccaccgcatggttggcattgggttccccccggctgggcagcgaaacttgacagtgttggccgcaggcacagcatggagccgcttttccatcttttctgtgttggtccagtatggtgctctcttgttgttactgttctcactgacaaaatcttccgcaccatcgggtgtcatcctcatcatctccggatgagatggcatctgtgacattcaccatgaagtacccaagtttcactgtctacagtcctactggcagtacaagcatagaggccggagtctctaggtgtggcgccctttatctgcaagtactccccaataagcactgtcctattgttgggccccaagtgcaccccatccttagtccaactgatcacggcggcatctttcaacaggcagcgcacctctagcgactcccctggcgcagccacgtacacttctggttgagagatttggtatttggttggtggctcttctggctctaatgtggtatcctcaactaaactgaaggagggccgggccagggacaaggttgccatggtgaccacgaccaggcagatgaaacgaccccagctgaccatggttacggtaccaatccccggtcctcttccatatctccatgtggacgttaatcccatctgcacacttcctctacgggcatggactacgcgcaatgccttcagcctgcggtgggctcaggaaccgaggcgctgccgctgctgctgcagtcacttgaatggcaacgctcctccgcgacctgtgttgtccccgcgccccgcgtgggtcgggatggagaaagcgacgagcccggggttgcggggagcaactccaaacgcagaaga

SEQ ID NO: 3642 - DNA, 1705 bp, Homo sapiens
gtcagcggggaagctggaaggcgtcgttctcctttcccagctctcatgcctctccgccattgttttcaggccgggtctggcttggtcttcccccgtaaggaaatggccggggagctccaggggacccaggcgccgtcgcttcggcggagctgggcctgaccagccaggacagcggggtaaacgcggcacaattctgcgcgaggtagggaggccatggcgtccggcagtaactggctctccggggtgaatgtcgtgctggtgatggcctacgggagcctggacttgaaagaggagattgatattcgactctccagggttcaggatatcaagtatgcagccccagctccttgcagatgatgatgcttagactacttacaactggaaacccaggggaaatcaaagttgcttacaactatcttgttatagggatggaaagctctggatgccattcgtacctctgagatcccatttcattctgaaggccggcatccccgttccttaatgggcaagaatttccgctcctacctgctggatctgcgaaacactagtacgcctttcaagggtgtacagcaaagcactcattgatacccttttggatggctatgaaacagcccgctatgggacaggggtctttggccagaatgagtacctacgctatcaggaggccctgagtgagctggccactgcggttaaagcacgaattgggagctctcagcgacgatcaccagtcagcagccaaagacctaactcagtcccctgaggtctccccaacaaccatccaggtgacatacctcccctccaactcagaagagtaaacgtgccaagcacttcctttgaattgaagagctttaagggataactataacacattggagagtactctgtgacggagctgaaagaacctctgccgcagaataaagccacgccagtttcaatgtgccagaacagggctcttgccggggccggccctcgggaacagtcgtgcccaagcaggcccagactgtatccatccaagttccccgttgtatcagagtttcttagagcttgtgtctaaaggggtattcccccaccccctccttatgagcattttagtaacattggctatgactattttccacccagtagcgcttttttcctggatttgcattcaaggtgttattccttaaatgtttcctgtccaaggcttccttaaaaaatcttccactgggttttccagcccatagtttcaccttcccctggttcccaggtttatttaatcccccaaaggtgaagagttggaagtgagatgtccttcccatatcctataccctttgtgcacaagttgaatggggaactgtttggggtttaagggcatcttagagttgaattgatggaaaaaagcagacacggaactggtggggaggtccaagtgggggaagttggtgaatgtgggaataacttacctttgtgctccacttaaacccagatgtgttgcagctttcctgacatgcaaggatctactttaattcccacactctcgattaataaattgaataaaagggaatgttttggcacctgatataatctgccaggctatgtgacagtaggaagggaatggtttcccctaacaagcccaatgcactggtctgactttataaattatttaataaaatgaactattattcaaataaaacgtatgaatcagtaaaaaaaaaaaaaaaaaaaa

SEQ ID NO: 3643 - DNA, 567 bp, Homo sapiens
ttctttctttctttctttctttctttctttcttgtctttctttctttcttctttctttccttttcttctctttctttcttctttctttcttctttctttctttctttttctttcttctttcttctttttttctttcttctttctttctttctttttttgtattttagtagagattgagttttgccatgttttccaggctgatctcaaacttctgattacaaaaaatccacctgcctcagcctcccaaagcattggaattacaggcatgagccatcacagctgtctacaatatacttttacatttatgatttaggtgatgtgttcttctctttctgtcaggtgcgggatggttaaatatcactggacctagcacctagggaatgtgactcttgtcttttgcatcagccccactcgttttgagaactgtaacatatcactgggccaaacacctagaagatgggaagtgtctgcctatgccctgcaaacagggctttagccctaccactctcaagagcctcgtgacatatctctgcattcatcatctaggagatgtgactcctccctgct

SEQ ID NO: 3644 - DNA, 3759 bp, Homo sapiens
gctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaagaaagggagtttgggcttgaaatcccacaaaaggagatttctaagaaagcttcatttcaaaaggatatggtaggtgagttcacaagagatggttcatggtgttccattttagaagaactgaggctggatgctgaccgcacaaagaaagatgagcaaaatcaaattcaacccatgagtcacagtgctttcttcaacaagaaaacattgaacacagaaagcaattgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgttgggtctggtcagctattcagccatagctcttctgatgcctgcagcaagaatattcatacaggagagacattttgcaaaggtaaccagtgtagaaaagtctgtggccataaacagtcactcaagcaacatcaaattcatactcagaagaaaccagatggatgttctgaatgtggggggagcttcacccagaagtcacacctctttgcccaacagagaattcatagtgtaggaaacctccatgaatgtggcaaatgtggaaaagccttcatgccacaactaaaactcagtgtatatctgacagatcatacaggtgatataccctgtatatgcaaggaatgtgggaaggtctttattcagagatcagaattgcttacgcaccagaaaacacacactagaaagaagccctataaatgccatgactgtggaaaagcctttttccagatgttatctctcttcagacatcagagaactcacagtagagaaaaactctatgaatgcagtgaatgtggcaaaggcttctcccaaaactcaaccctcattatacatcagaaaattcatactggtgagagacagtatgcatgcagtgaatgtgggaaagcctttacccagaagtcaacactcagcttgcaccagagaatccactcagggcagaagtcctatgtgtgtatcgaatgcgggcaggccttcatccagaaggcacacctgattgtccatcaaagaagccacacaggagaaaaaccttatcagtgccacaactgtgggaaatccttcatttccaagtcacagcttgatatacatcatcgaattcatacaggggagaaaccttatgaatgcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagccttcacttctaagtctcaattcaaagagcatcagcgaattcacacgggtgagaaaccctatgtgtgcactgaatgtgggaaggccttcaacggcaggtcaaatttccataaacatcaaataactcacactagagagaggccttttgtctgttacaaatgtgggaaggcttttgtccagaaatcagagttgattacccatcaaagaactcacatgggagagaaaccctatgaatgccttgactgtgggaaatcgttcagtaagaaaccacaactcaaggtgcatcagcgaattcacacgggagaaagaccttatgtgtgttctgaatgtggaaaggccttcaacaacaggtcaaacttcaataaacaccaaacaactcataccagagacaaatcttacaaatgcagttattctgtgaaaggctttaccaagcaatgaattcctagtgcatcagcatattcataaatgaaatatactccgagtttcttgaagaagagaaaatcttctcagaatcaggtctaattatatgttattgaattcatgcttcagaaaaactctagggatgcactgcatgtgtgaacacatgataaaaaagtcatgctttattttagtgagggcaattacagagaaaagagtaagcagaaatgtccttctgagtactggcctcattaaggattataaattttctccccgggaagaaaccctgactaacgcattgagaaaagcctttctgtaaagaatggtacaagacaggttgttactcgattatttatagtaaaatatgtgggaaattatatcaatgataaccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatccctaatctgaaaatccaagattaaatgctccaattagcatttcctttgagcgtcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcgtatgtatgtatgtatgtatgccctcagtgcagtggggtttgctgcagaattcactgcatagcaggagatgtaagcagatgagttattttttaagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacaaaaaaaaaaaaaaaaaaaaaaaa

SEQ ID NO: 3645 - DNA, 491 bp, Homo sapiens
agatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaaggattagctcagcttgcccccgctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggaaaa

SEQ ID NO: 3646 - DNA, 627 bp, Homo sapiens
gaaattatatcaatgataacccacatattttactataaataatcgagtaacaacctgtcttgtaccattctttacagaaaggcttttctcaatgcgttagtcaggttgttactcgattatttatagtaaaatatgtgggaaattatatcaatgataaccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatccctaatctgaaaatccaagattaaatgctccaattagcatttcctttgagcatcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcgtatgtatgtatgtatgtatgccctcagtgcagtgg

SEQ ID NO: 3647 - DNA, 549 bp, Homo sapiens
  misc_feature (1)...(549): n = A,T,C or G
acgggaggcgggaatttggactaagaaggaaaaaggcaaccaaacaatgaaaggtctggcagccatagggaaagaagggtaggatgaaagatgaagtaagccctcaggccagtgggttttccgcagaaattcnctgaatagcagaaaatgtaggcagatgagtatttttttagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggaaa

SEQ ID NO: 3648 - DNA, 532 bp, Homo sapiens
  misc_feature (1)...(532): n = A,T,C or G
agagtcaagctctgtgctgggacttgtgtatataaaaatgagtaaaatatgcttcctaccccggtggagttcacagtcttggtggagttcacaatctatctcaaaaaacttgttaataacgttatgacaaagcacaatagggttatgttaagttatataactggactatgagagcaatgggaaggttggggaatatctgagaaaaggtgatgcctgaataaaagaggatttaagaaaacagtcttggaaaaagggcaccttgagccaaacatttaggcgtggtgctctggagaacagccccagaagtctagggtggagtttaagctacaagacattccatgttgtcttgtatcatatatacatatatatatataaaacacacacacacacacgtatttatatatatatacacatatacatatatacacacacatatatacacatatacatacatatgtatacacacacacatacatatatatatatatatatatatatatatatatatatacacacacactntttttttttt

SEQ ID NO: 3649 - DNA, 507 bp, Homo sapiens
ctctctctctctctctttctttctttctttctttctttctttctttctttctttctttctttctttctttctttttctttttctttctttccttctttttgagatggagtctcgctctgtcgcccatatcatttttagtataatctcttcctttacttggtcactaagaatcacttttctctacttagagccagacatttaaatatctccagcctccaagatctcgtctgggtacttgggctgcactttttcatgtcaatcattttgcacttgtcatctatcctattaggctataagctccccaagggcagatatagagacatagtatcaagctaacctttttatttatttatttatttatttatttatttatttattttgaggctgggtctcgctctgtcatgcagtctggagtgcagtggcatgatcatggctcaatgctgcctcaacctcccaggctcaagcaatcctcccatctcagcctcctgagtagcctgggactgcaga

SEQ ID NO: 3650 - DNA, 578 bp, Homo sapiens
ccctgtctcaattttacttgaataaataaataaataaataaataaataaataaataaataaataagaagagccttccagagcagtatggaatggccaatgcccctcctccctgctgctcctcctcctgtagctgtttccttctcccctctctccttgcttggaacagccacagcgactctccaaatcatgacactcaaaatgccaccttctaaaaagaacatcagggttggtgcctctgcttcttctgaattgacctcccttctctgccctcttctgactcgtcctcccttctcttttggatgtaattctttccagcctccacactcctttgacagaagatgaaaaatttgtatctctgaatcctatatctgcttgtctatgatctaaatactttttgagtcaacaaggtgaacatattcctcatatttcgttatggaatgtttaaaacgtctaaaatacacactgccactgagaaagtaaattcatgcacctacaaagagaaaggaaaggacagccatccaccatttgactactgagtttccacctgcacccttcgacacttattagaactttcatg

SEQ ID NO: 3651 - DNA, 2150 bp, Homo sapiens
  misc_feature (1)...(2150): n = A,T,C or G
ttttttttttttttttttttttttttttttttttttcagtcttccacttgcccaatatttattttttatttaatatttttcatattgtgccatttcctcagcatttacttacaaatttaagttccttacattaataggttttccctcatgtgaattctctggtgttgactaaggtttgagctctgactgaaggctcttccacactcactgcattcatagggtttttctccagtgtgaattctaaagtgtcgaataagatgtgagctcactcggaaggttttcccacattcactacactcgtagggtttctctctggtgtgaattctctgatgcctgataagatgtgagttcaggttgaatgctctcccacattctttgcaaccaaagggtctttccccagtgtgaattcgccgatgtctagtaagatctgagctctctgcaaagcttttcccacattcattacattcatagcatctctctccagtgtggattctctgatgcctagcaagttttgagctgtgcctgaaagctttcccacattcattacactgatgagttttatctccactgaaaactgctgcatgtttagcaagttttgggctcttgaaagattttccatattggtgatttttttctccagcataaattatttgatggttaataaaatctgagttccatttgaagctctggtcacaggtaccatgtttacaagatttctggtgtgtgaattcatttgagttcagatttaatctcctctcacatccatcgtggcttattatttcacctctgactgtatttttgtgggtgaggattttaccaaaaccttcatcctgggcagacgagagtctctgagactcccctgattctttttcccattgtctctttaccctgcctgcagacttacagatgtcttgagactcaccagatgcttctgatatgtatcctgagattcttccagatataattctctgtgattcaattttttcaaaaatttccagctttggcatggatctactgttttcactctcattatcacagtcccataggagctggggttctgatgaatcaaaatgggccttggtctccactggctgtaacttgacattaagtgctggtccaggaggtgacacttttttctggaatatttcttgtccatgttcatgggcttgaacctggagtactgcttcatcagtgcctctctccaaatcttctagtatggtcactgcctcctctccactctctgggtaatgttcatgtacccaggcctgcaaatctcctggcaggatggtcaggaactgctctagcaccagcagttccagaatctgttccttggtatggatctctggcttcagccactgacagcagagctcccggaggcggctcagtgcctcgcgaggtccaggagaatcctggtagcagaactgcctaaaaagctgcctgcagagctcctgcttaaggagttcacttctctgtaagcaagtgtcctgcccatggataaattcttcctcttctatcttcactatcagaagtccttcatcctctggagagttctgggctgcagctttctttggttctgtagccatcttgtgtttctcaagggcagggggtcagtgttggtttaactgcatcctcggcacacaggaaatactatttaccgtgtcaataaatttcaggacaagcggggttgtccccaagtgtcctacaaaacggcggttactcttcccaagggaagcaggggattggggatggtcctcgcagcagtttcttttcgcagacaatggcagatctgagacatgtggctacccctccccgttccacctggntggaatgggcaactcntnttaccagtgacccaaattcaggatcagtaggacagcccccaccccacgccaccaagccctcagcgctccantatgangtcacgcgcggcggcggtaantatggagaccgccaaaccctcactaaatgcgtaagcgcgcctgcgttcccaacgcgaagctggttntacctttntccgggattcctctgagggccaaggtctggtcacccagaggctgctaatttcaaaggcaatatgagagggactggatgtttggagggggacacggggctggacatntggatccccaaacccgcgcggatccgggacc

SEQ ID NO: 3652 - DNA, 1109 bp, Homo sapiens
  misc_feature (1)...(1109): n = A,T,C or G
cacgtngactgcgtgatccacctgccttggcctcccaaagtgctgggattacaggagtgagccaccgcacctggccacaagttctctcttttcattgggtaataaaggaaaggaccatntacagttaccaagactagtttgtggagggagattcattcccctgtttctttagtgatgtgcactatatggcattctgcccctcaccacagtcccataggagctggggttctgatgaatcaaaatgggccttggtctccactggctgtaacttgacattaagtgctggtccaggaggtgacacttttttctggaatatttcttgtccatgttcatgggcttgaacctgagaaaaataaagtacatttgggcttataaaagaatccctgtgttaaacgtcttctaacaacaaagagaaactcccatagaaatgcaaaactggggaaggaagaatcgagtctgatttaattgtaaaatgtagtgtggaatcaaacagacaggaaaggagacataaatgcacactgaaccaacagctcctgcaagctagatatgcaatctcgggcctctcctcccaccgtggaactttatccattatggaggtcttagatctcccatcccctgtgcacctggagtactgcttcatcagtgcctctctccaaatcttctagtatggtcactgcctcctctccactctctgggtaatgttcatgtacccaggcctgcaaatctcctggcaggatggtcaggaactgctctagcaccagcagttccagaatctgttccttggtatggatctctggcttcagccactgacagcagagctcccggaggcggctcagtgcctcgcgaggtccaggagaatcctggtagcagaactgcctaaaaagctgcctgcagagctcctgcttaaggagttcacttctctgtaagcaagtgtcctgcccatggataaattcttcctcttctatcttcactatcagaagtccttcatcctctggagagttctgggctgcagctttctttggttctgtagccatctgtggatacaatatattatcaggaactgctttggaaagggtcttctttagtttcaagagtcctcctgagggatc

SEQ ID NO: 3653 - DNA, 1049 bp, Homo sapiens
  misc_feature (1)...(1049): n = A,T,C or G
cggtttttttttttcagtcttccacttgcccaatatttattttttatttaatatttttcatattgtgccatttcctcagcatttacttacaaatttaagttccttacattaataggttttccctcatgtgaattctctggtgttgactaaggtttgagctctgactgaaggctcttccacactcactgcattcatagggtttttctccagtgtgaattctaaagtgtcgaataagatgtgagctcactcggaaggttttcccacattcactacactcgtagggtttctctctggtgtgaattctctgatgcctgataagatgtgagttcaggttgaatgctctcccacattctttgcaaccaaagggtctttccccagtgtgaattcgccgatgtctagtaagatctgagctctctgcaaagcttttcccacattcattacattcatagcatctctctccagtgtggattctctgatgcctagcaagttttgagctgtgcctgaaagctttcccacattcattacactgatgagttttatctccactgaaaactgctgcatgtttagcaagttttgggctcttgaaagattttccatattggtgatttttttctccagcataaattatttgatggttaataaaatctgagttccatttgaagctctggtcacaggtaccatgtttacaagatttctggtgtgtgaattcatttgagttcagatttaatctcctctcacatccatcgtggcttattatttcacctctgactgtatttttgtgggtgaggattttaccaaaaccttcatcctgggcagacgagagtctctgagactcccctgattctttttcccattgtctctttaccctgcctgcagacttacagatgtcttgagactcaccagatgcttctgatatgtatcctgagattcttccagatataattctctgtgattcaattttttcaaaaatttccagctttggcatggatcacgcagtcgacgtgagacnaacgcagtcgacgtgagaccaacgcagtcgacgtgagacc

SEQ ID NO: 3654 - DNA, 656 bp, Homo sapiens
agaattgaagagttacagagaacaatttaagagtctgaatttcctttcctttatttcaaaaaaagtaaagaattatcccaggttcttgggcatctcaacgattttttccaaacaaatgcctcaaagagagagaaacagcgagagcgagcaagcgagacagacagagagagagagagagagagagagagagagagagagaaagagagagagagagcacacatcagcaaaaaaggaaagagactgggtaaagtctacctacttgcccaagaatgccacgttctacaacctgctttatgtgcagggagaagggcgtatcttttgtcaaagtggagtaaactttaaggatgagtaatttatttggaaaaaaagtatgttcaagatgctcaatggggaaaaagtgttcacttaaaagcaaaatgtgagatggtggagaggaaagaaacatttattcaaatcagccaggccactctgtttcccttatagcaaaagccaaagagcagctcaaattttgtgaacactattctctttaaaggaaaaaaacccaaaacacctaaattaaaattcaaaagaaagaaaccacacacaaccccccaccccaaaactttaaaaatcaaagagcctctcctgagccatctcaatactgaaactgttctttc

SEQ ID NO: 3655 - DNA, 508 bp, Homo sapiens
aggtagtctacattccaagattagaacataatgaagttagaagggctgcattctatgaggcagggagaattagacatggaattacagagcttttcattgcaatttccatgactgttatttatgtgaacttacacaaatctaaggatcactctgagccacagtttctttatcctattctgaaatctctttaaaggacttgagtccaagctctctcccacactgcaagaccccactgcaatggctcctatagctgctgccatggcctcctccaatcaagtcagccttactatcttaaaaaaagtaaataagggcagctaaacgccatggcaaatgtatacctatgtaacaaacctgcacgttctgcacatgtatcccagaacttaaagtaaaatttaaaaaaaagaaaaaataaataaataataacatctctttaaaaaaaaaaaaaaaaaaaaaaaaaaaaaaaaaaaaaaaaaaaaaaaaaaaaaaaaaaaaaaaaaaaaaaaaaggg

SEQ ID NO: 3656 - DNA, 574 bp, Homo sapiens
gcggccgcccttttttttttttttttttttttttttttttttttttttttttttttttttttttttttttttttttttttttttttatttatttatttatttttgaaacagagtctcgctctgtcacccaggctggctgaagtacaggggttccatctcggctgactgcaacctctgtctcccaggtgcaaacgattctcctgcctcagcctcccaagtagctgggattgcaggtgtgtgccatcacacctggctaatttccgtatttttagtaaagacagttttgccatgttgaccaggctggtctcgaactcctgacctcaggtgatccgccagcctcggcctcccaaagtgctgggattacaggtgtgaaccactgcactcctctgcggtcgccacctgtctgggtgccggtctcctccctgcctggccgcggcgcgtcctccccggttctcgcagtcgtcgggctgtgcgcttcccccctccagctacagccgcagcctcttctcttcgggagggacgtcgtcctcctccctcctgggccggccatccctgcctcggggcttgccagtgg

SEQ ID NO: 3657 - DNA, 419 bp, Homo sapiens
gatagtttaaataatatattttatagggaaaatcacagtaacatccacataaatctggaactaccaccactttccagaggctgaatcccatttgtggagtctcttgcgtgtcaagtaccttgcagtcagctcaattatatacttttgggattcgttgcagagaagagtgaagttattcctctgccgtcgccacctgtctgggtgccggtctccttcctggccggccacggcgcgtcctgcccgtcctcgccgtcctggggctgtgcgcttcccccctacagcaagagccgcagcctcttctcttcgggagggacgtcgtcctcctccctcctgggccggccatccctgcctcggggcttgccaggggcttcggagctgccggaagggctggccatggctccgggggctctgcctgcacc

SEQ ID NO: 3658 - DNA, 447 bp, Homo sapiens
tttgatagtttaaataatatattttatagggaaaaacaaagtaacatccacataaatctggaactaccaccactttccagaggctgaatcccatttgtggagtctcttgcgtgtcaagtaccttgcagtcagctcaattatatacttttgggattcgttgcagagaagagtgaagttatctattctctcttacgtgatgacaaacttgttgaaatgtcatttcattttgtggctccagccccaggtattctgactctgattctaaagggtctgcatgcagagcgagcaagccacctagatgattctcttgcaggtgttttaagggcaggagtttgagacaccctgatgcaaaagaacgaaccctcaaggaagttggctgtacgggtattttccttcctgtctgggtgccggtctccttcctggccgaccgcggcgcgtcctgcccgt

SEQ ID NO: 3659 - DNA, 1155 bp, Homo sapiens
gcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctcttaacttccacacatcctccacccgggggggtgctcgcggccacccatcttggtcttgtggttaggggacagaggaaaacttgggtgttgcctcctgggtgttcacagaactggattcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaaaaaaaaaaaaaaaaaaaaaaaaaaaaaaaaaaaaaaaaaaaaaaaaaaaaaaaaaaaaaaaaaaaaaaaa

SEQ ID NO: 3660 - DNA, 486 bp, Homo sapiens
cattttttataagtgcattcaccaatagagggcccacctattctggtggagagaattggaaaaggttccagaatccgggcagaagcctggctgttcccggtgagggctctcccttgctagcactccctcccaccctcactctgagcaacacagctgctcatgtccctggagaggacagctttggccaagttgttaaacatctctgagcctgtcttcccatcttggaaatgggggcagttgtcccaatgccgagataattgagtgtgaagccctcccctgtcccatgctgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaaacccc

SEQ ID NO: 3661 - DNA, 410 bp, Homo sapiens
ggcaaggagaaatcttccgcctctgggcctcaggctgcctgtccataaaatggggacatggccagctgacggcaactgagtctccggcccacctaccaccgccagccaggatccccaaaagtgtgcagagggctcagcagagaacagtatgggacccctcacccaggcctggaacacctccagccacaaagaagccaaaggtcagtccctctgctccccagcaaacggtgcctcccaggcattctcagtgccagggcttcatccctgtgaaggcacagggcctggggcagaggagggctgcaccaggcgtcctggggaatgtgctcagtgaagacgacactgggctttgcacagcctggtgtcgctgtacagaaactgtcaagggaataaagtgttctttgttttttaaa

SEQ ID NO: 3662 - DNA, 412 bp, Homo sapiens
  misc_feature (1)...(412): n = A,T,C or G
ccttccccttctggcctcagctgcctgtccataaantgggnacatggccagctgacggacaactgagtctccggcccacctaccaccgccagccaggatcccccaaagtgtgnagaggggctcagcagagaacagtatgggaccccctcaccaggcctggaacacctccagccacaaagaagccaaaggtcagttcctctgcataccccaggcattctcagtgccagggcttcatccctgtgaagcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgtttttt

SEQ ID NO: 3663 - DNA, 924 bp, Homo sapiens
tttcgagcggccgcccgggcaggtactaattttttttttttttttttggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctatgtccgttgagaacattattttaacaagaagaacaccaacagtagcatgaaatataatactgttttataattctaaagctgctgttaatttatgaagtacataataatctaatgtaaactgcagaagtcagagcaagtgcctacattttgttatttttggcattactacagagccatgtacaatagaaagcaatgcaagacttgtaaactctcaccacttcttgtaatatcaaatgttccccctcaggttattttgcttatggtacccatgagttgcctctctctgtacatagataaattgttccaatattttcctttgatgtttggaactacagatagtcaagggctggaaattttagttttcaatataagcttccagcttagcaattacctctagtccaagacaatatttgattcctagttctgtttggggcaaattttcatttatctaaataaaatgcaatctaattaaaaaaaaaaaaaaaaaaaaaaaaaaaaaaaaaaaaaaaaaaaaaaaaaaaaaaaaaaaaaaaaaaaaaaaggg

SEQ ID NO: 3664 - DNA, 600 bp, Homo sapiens
ttttttttttttttttttttttttttttttttttttttttttttttttattttttatttttttattattatactttaagttttagggtacatgtgcacaatgggcaggttagttacatatgtatattctacacataattttactgtaagaggacattataaacacattaacccaataactggcacttataccattttcgagttgaactactgacacctcttctagtggctccatttaaccacaaacttgaaatagaagaaaataacctttctcttccctaccctcccacacttttgctccccaaaaactcatttgaggatcatataaagaaggccgggtacagggtctcatgcttccaatcctaacactttgggaggccaaagtgaaggatcacctgaggccagaatttcaaagccagcctgagcaacacagggagaccctatctctacaaaaaaatttaaaaattagccaggcatgatggtgcttgcctgcagtcccagctacttgggaagctgaggcagtagggtcgcttgaacccaggaattcagggctaccgtacgccatgatcacctcactgcactccagcctgggcgacagggc

SEQ ID NO: 3665 - DNA, 4664 bp, Homo sapiens
ttttttttttttttttttttttttttttttttttactgtgttaaaaaaaagatggcacatttattgctacataaatgttatatacatattgtgttttctgttacagtgacagaaaaaaatttgaacttcttgctgctggttgaaaaggtttatcaataataccttgaatttgacacaggatacaaatctgcaataaaccaacaatggaaactggagaacaagatgagaagcaattcatctccaacaattagctcttacaatactccataggtactacacggtatgctagaatcctactatggtcttaaaatgctattgtaaatttctgatattaatgaacaggttatggtaaataaccctacattttttactacctaatataataaaataaagtaagaaactttttactgaaaactttttgatttcaaaaatctagaaagagtaatatttagaattcaagaaattttcttacaagattattgtataaaagactagctacagtgaaaaataagccaaatgtttttttctttctattttatgaaggaaagcttctgggcatactgcaaagtctaatatagcgaaaaagacaacaagctctgaagaaaaaaaggccaggcagtggcatatgttcactcacacatcataagcaacaacttctgtttagctgattaacactgaaatgaagaacaaggccacagatagagtccgatgtaactggagaatatatgcaaattaaagtaaccaaaaagtccactaagttcacaaatgactgacttgttaggaatcatcctgattagagtaccagaagttctgtcttgtttttgttctttcaaattaacagaaatctttaagctacatagtgatttgggtcctttcctctgtgtgctgattgccactgttgatattggctataaggaattattaagccaagatacctcctttagcatgtttttctctcccagggttgttgtggtggaagacaggtttcatggaagttcaaagtgattatgtcttttaaaacaactcctaaggattagagacagagagtgccttaatgaacagtattaagatggactgacaagtactggtttaatgctaatctggctcatcattttgggacaggggcagatggtttgcagttgattaaatcacccactcaattcttccccattgaccagccatccaaatgacagagaaataaaggctaggataaggaaatacgggtgaccattgctcttgtattccattaggtaattagcctcagagtggtgtgttcatttatcacactacctgccttggtgactactgggttttgttatgttcaccataatcacagcctgaaaaaatcgtctttgtattttaaatgtattttgtgcttacttacagctaacactttacaagtactgtatgtagtacttactgcttggaaaacaaagcgatttctaaaaagtagattcttcccttgtaatttacaattttgctattacaagctttcctatgagatctagaagcttgaaaagtcttggttattattagaaataaagcaatgtttatttgggggaaaacctagagaacaaaatttccccttttaaaatgctagctaggctatggtcacagatggtctctgcttaccactgtaaggtaaatgtgcaaagcacacagggctgcacggaggaggctggactgtgaccataaactgttcagatttagagatcaaatataacacccacaaagagaaaataaaaataaatcaaaaaatgagagcaagagaaatgctataccaagtaatattttcctatttcatggaaaacgctattcatatggcaagaggataggagagggcaacaaaagacttttcccttcctttttaagacactaataggtatgccgggaatgctaagggccaatggttgtcactgctttgttctctgcacgtgaaccgctttaatgtatgctggcatcagctgagtgtagatcagctttccacattaactttttccctttatatgtagaccttacagtttcataacaataaataaaatttgtagttacaatgcatttgtcaattcagtttaggcacaaggcaacttccacggtgagtggagagatcgagacagtctctgattgtgcagaagcgacacactgcttgcaacaaaagatttgttgcaaacatctcatgggctgatgttctatctgatgagcttcctatcttcacttctgatggaagtgttgaccagttgctttgatcgtaggattacatttgagtttcttggttcaagtgttttgttttttcttctccctcctgtcaggtttgtgtcttcagataatctgagttgtccaagtccttatgaggagaggtcaccttctatctagcctactgataactctggaactggctgatgtttacatatgacccatagggttggtagtttcactaagcccaggatgggttcctggcagtgtggttggcggctctgccgatacggcagaaactttttcttcttcccttctcttaaggcaggctgctttggggttaaggttcctctctctgacttgctgttctagactaaggatgactgccacggcttgatgaagaataaggagttttgtttggggtttttcactcttcaagtgaagctgacacattcggccaagctctttgaatgcttcattaatatcccgcacgcgtaagcgttctctggcattgttagccatccgcctctccttctccctttctatcttctgttcagggttcaaatcctcatcttcattagtactgcttgttctgcctctagatgaaaccttgatatctttttgggaggattcatcatctgacttcatgtcatctgatgaaggaggttcatgaaggttttcatccttttctttgttttcagtcttgatttctgttgtaacaacagttccagactgactttgcaagccacctctataattttcttgtgttttatggttcaggtctgtgcttgaagtagtgactgtactagacaggactgaatgattgccattgagactgacagagtcttcccgatgagttccaaccattgaagctgatcgactgcttgcaacaaggcttgatcctccatagtttgaattgaggcttccaattggtgcattatgggatggtcccaataaactatgtatatcactgtgaccagcaggcaaactggtggaaggtcccacagcatggttccgcagcacatggattgcatcatccagtctgtctaaacgatcctccattcgagactgcagggagtggagtgagttttcatagcttggggatgaaggtgcttgccctccaggtcttggccactgactggtacctgtgagaggtgaaggtgatccaactggtgttgatggatttgacggaaaactactgctggtatggtcaggagaataaatagatgccaaagcctttccaagtgcatcacctgtctgtgagcttccagcagcattccctctggttcctagaatgctgtctgatccattgatgggaggagtgtgtgaggcagcaacgtaaggtgaactgctggtactgccgcgatgaaagctggacattggtggaagactcgtgtttatgtctgttggtgaaactgagtgtggaggataactcaagcggtcatgtgaatgaaggttgccataactactggattgagacatgtgggaagtggaggtccccagaattccaccaaaaccaggctggctcatcccatttgatgaactccaaaggtcagaagaattgtgggtcccatcttgcataaagaaagtgctagcgaacatactggttggtggcttaggagatggataactaggagattcacggttgaaatcatctgaatttggggatggtgcatatacagaagaaggcaaaccaggaggcacctttctgactttttttgcttgcaagggatcaagcgctgcagagtcatggagtggtctcctcctggaacttgtagcagagaatgaatagtatgctgtcccaggttttcctgaagaagatagctgtgctgggctcccaagccccagatcttgtctcaggagactagattgacagcctggtaatccagtatctctgctgtacagggaaaatgagcctctctctgatgtttttcccatcagatttgagttcatgaaaggtgtcggggacaagccttcatgggctcctaatcgactgtcattcaagtgatcactgtaatgagggctgtctgtaaaacctctagatgaatcataggaaggacttggttgaccacttgttccccaagatgttgtacctcctctttcatcaatacctgatccactgaattgactgcttcccagtgtagttggtctagttttcccactattaacaggtggggaaaacatcgcactgaagtccagtaggtcgctcagctccttgtcggtccctatagcggccatgcgttgttgctggggattcatcttcggccacttctagcaggtcctgccgccccgtctccgcatccaaccaccccgattaaagttcactttggccgggagaacgggcttgggcttccccctgcacgcccagcggctcggttcactttgccccgcacgagctctcgggtctgggagggggaggcggctttcgggcctggcgccccttcctcccggggcgggctgtcggtcccttt

SEQ ID NO: 3666 - DNA, 865 bp, Homo sapiens
  misc_feature (1)...(865): n = A,T,C or G
tttttttcttaatttttgcttttatggggntaagggtcctctctctgacttgctgttctagactaaggatgactgccacggcttgatgaagaataaggagttttgtttggggtttttcactcttcaagtgaagctgacacattcggccaagctctttgaatgcttcattaatatcccgcacgcgtaagcgttctctggcattgttagccatccgcctctccttctccctttctatcttctgttcagggttcaaatcctcatcttcattagtactgcttgttctgcctctagatgaaaccttgatatctttttgggaggattcatcatctgacttcatgtcatctgatgaaggaggttcatgaaggttttcatccttttctttgttttcaggcttgatttctgttgtaacaacagttccagactgactttgcaagccacctctataattttcttgtgttttatggttcaggtctgtgcttgaagtagtgactgtactagacaggactgaatgattgccattgagactgacagagtcttcccgatgagttccaaccattgaagctgatcgactgctttgcacaaggcttgatccttcatagtttgaattgaggcttcccattggtgcattatgggatgggtccaaataactatgtatatcactgtgaccagcaagcatacttgttgaaggtcccacagcatggtttcgcagcacatggattgcatcatccagtctgtcttaacgatcctccattccagactgctcacagacttccttttaagaagcaattgcatcttgcaaatgcttcgtgagttgctgctcaactcgatttttcagggagtggagtgagttttcatagcttgggga

SEQ ID NO: 3667 - DNA, 365 bp, Homo sapiens
ggaaagtggaggtccccaaaattccaccaaaaccaggctggctcatcccatttgatgaactccaaaggtcagaagaattgtgggtcccatcttgcataaagaaagtgctagcgaacatcctggttggtggcttaggagatggataactaggagattcacggttgaaatcatctgaatttggggatggtgcctcctggtttgccttcttctgtatatgcaccatccccaaattcagatgaaggcaaaccaggaggcacctttctgactttttttgcttgcaagggatcaagcgctgcagagtcatggagtggtctcctcctggaacttgtagcagagaatgaatagtatgctgtcccaggttttcc

SEQ ID NO: 3668 - DNA, 278 bp, Homo sapiens
ttttttttttttttttttttttttttttgatttaataaagttttatttttccaaatgtacagctggtatggtcaggaaaataaatagatgccaaagcctttccaagtgcatcacctgtctgtgagcttccagcagcattccctttggttcctaaaatgctgtctgatccattgatgggaggaggtgtgtgaggcagcaacgtaaggtgaactgctggtactgccgcgatgaaagctggacattggtggaagactcgtgtttatgtctggttggtgaac

SEQ ID NO: 3669 - DNA, 434 bp, Homo sapiens
ataaataaaatttgtagttacaatgcatttgtcaattcagtttaggcacaaggcaacttccacggtgagtggagagatcgagacagtctctgattgtgcagaagcgacacactgcttgcaacaaaagatttgttgcaaacatctcatgggctgatgttctatctgatgagcttcctatcttcacttctgatggaagtgttgaccagttgctttgatcgtaggattacatttgagtttcttggttcaagtgttttgttttttcttctccctcctgtcaggtttgtgtcttcagatatctgagttgtccaagtccttatgaggagaggtcaccttctatctagcctactgataactctggaactgtggcagggacagccaagggagaggacaataccagttagtacataattgttaaaaataaaacaccttccctc

SEQ ID NO: 3670 - DNA, 432 bp, Homo sapiens
  misc_feature (1)...(432): n = A,T,C or G
anntggcacatttattgctacataaatgttatatacatattgtgttttctgttacagtgacagaaaaaaatttgaacttcttgctgctggttgaaaaggtttatcaataataccttgaatttgacacaggatacaaatctgcaataaaccaacaatgggaaactgggagancaaggatgaggaaggcaattcatctccaacaattaggctcttacaatactccatagggtactacacgggtatggctaggaatcctactatggggtctttaaaatggctattggtaaatttctggatattaatggaaccgggttatgggggnaaataacccctacatttttttacntacccnaattattaattaaaataagggtagggggnactttttttacccggaaaacnttttttnggatttnccaaaatccggggagg

SEQ ID NO: 3671 - DNA, 4470 bp, Homo sapiens
  misc_feature (1)...(4470): n = A,T,C or G
ngcgcaactgttggaaagggcgatcggtgggggctttttgttattacgccagtgggaaagggggatgtgctgcaaggcgattaagttgggaacgccagggttttcccagtcacgncgttgtaaaacgacggccagtgaattgaatttaggngacnctatanaanagctatgacgtngcangcacgngnacgtaagcttggatcctntanancggccnccccntttttttttttttttttttttttttttttttttttttttttttttttttttttttttagttaaatacgcacaattttattgattgaagattaggacaaaaacattaaaccaaatacaggacaaagcaccagaggccatagatccccaccatgcatgtcaccaacctctcctcctccaaggtacttaaaaaataggggagaggggaaaaaaaaggtccttcttgacacagcaccatcttcagaatgttaaaaaaaaaaaaaaccttctctcctttctatcttccattagcaaaatagaatcaagggcaaatccatggccgccttgtctcctggttacgaagggtgaagccgccctcctgggaacgtgaggacagggctcctgctgcgcaggcataaagcatccaagagtctgcacatacatgccacacactattatgaagcacagattcaagtaacatttacatactagagtccacgtgtcacctacccaaaaacaggaccatttcacaaaacatatacaggcagtcaaatccgaacaagtgaggtactgggaacacaaatatttatgccaaaagagttctgtatcatacagcaatagaaaagccgtaataaaaaacattttgccactcgaaatcaaataaagctatctagaaaagccaagtaaaaggttatttcagagacagaaatactcaaacaaggaaaaagaattataaatgttaactacagcatgtaatatgtcatcccaagtcaacccgtaattgaagtactggcttaatacatcacaatgtgacattttccttaataaatagaagagttcttgaaaatacaaaggtgcgtattgggatagagagctgtttttatttatatcatcatagctttcagctaattatccttcccgcttgtctctactgagggtttttgtccaaaccagagggccttacaagccttaaaaggatcattctctgtaaagaaaactaaatagctgccctgtattttatacatgtgggacaacctgctttgtttcactagtttctaataaaacaaagacaaatgtttagttgcgatcagagtactgcaaaagcatcagactccaggagcttgctaaaatctcaggccattgctatcatctcagcatagaggaatgcctgtcacacaaaccctcattgttcaaaagcaaaacatgaaaaaggagttggatttctcttttcctttcttcttcccttttctttccccctttaaactaagatagcagtaatgcatctggacgtttgacttctaatagcttcctgccacgaaccaattgacacaaaacagaatagcttgttaaaggacagattttttcccccttcagggagcaaagcattaacatgtcatttcctgaccaggatattaaatagtttatttagaagaaatgagttgaagtgagcgattaagagacacaaactggacttttgttttcttttactgtagcacccaggtttcatgtcagtctgtgtgcaccgaattttttttttaagtgaacctcattaattaccagctaggtggttggcttgtttaaaagaaaaaaaattcttggccaactgttccttccctgaatcctaacaagaagttaaatgctaacagtgcgatgccaggatgtgtgtttgaggcagagagttttgattctgtcaggatctgcaactattttggaacaaaatgaaaagtggggtaggcggaagtggcccaagtggcaaggggtggtctcccaggctatgttagggaagacaagctccagcgggctcccatccatctcaccccaatccccatcccacgcctcttgcccccatgctacgtggtcagtcagctccttgaaggttttcctgctctgaaccaagaaacttaagagtgtgtctttcttgctactcagccaggcaattcgtgtcccccggaagaactcctttccgctgccctcgctcactcctggaacctgctaagtctccgtggggcatgagctcagttaaagaaagggtccaagttctcttccatgttgacgtccggcaccagctggtcagacacttccttagcaccatatgctgaattcgagacgctaaaatctgtagaaaaccaaggatggtccagaatttcctgcgaggtcagccgctctgagggctcccgacgcagaatgcttcggatgaggcacttggccttgggcgacagagtctctggaatgttgaactggccacgccggatcttgctgaagagggagctgggttcaatgtcatggaaagggtaccgccccaccaacatggtgtacagcatcacccccaggctccacacgtcggctgctttgcccgagtagctgccactggtgttcaagatctctgggcttacgtaagccgggcagccatgcttgtcggagagggaatcatcatctccccgcagaatgtaggcgtcttccaggctttccagcttgacccgagtcctctcttcgtccttaaagatgaatttccgcagcttgaggtcccgcagcaccagccccccgtcatggcagtgggccactgccgaggcaatctggtagaacagtctggctgcctcctcctctctcagcttcttgcaggtgcggacgaaggaatgcatgtccccatagcttcgctcaaagaacacataggctttggtctcacccaggataatttcagtgatttggttgatgttactatgagcagacaggcaaaagcacggtgccagggattcctggtagcagctgatatcaaacaccttgcacaccagctcctctccgctgtgcagatgcacggcacgaaaaacgtggtctccctccagaggttccaacaataagtatttcccgatacaagaaacgcaatgcgacaagttcggagtctcgggcgggctcggggagccgaggttcgggctgaaactctggctgggctccgcggaccttatagacgacaactcttcgaaatcctgggttttgttccgcgatctcccatatctcgctattgtgatgggggtagacctgtgtatgttcatgagtgtgaggatcgcacacgacaaacaaaaaaaaacccgctggagagatgagtcgctggcgagtgcggctgcaggcgcctcggtgccactgattttaaaagggagcgagaggggaggggacagaagaggggctgcgtggagaaagagttagaagcccccaaatgggcgccgccggatacctcgtctgctccgagcccggctcccgggggtcctcggtcggcaggcaactcgggtctttttgttaccccaaagcagtcggcgatgtgcagaatcgccgcacttttagttactctgtgtgtgtgtccccggcgtggatctggatgagtacccgggctgctaaggtgcggagctgcagcgcagggctcccgacgcgacccccaggccggcttccgaatcgcagacggggcggaggagcccgcggtagtttgtgcagtcttcggggagctcacggcggcgactcagtcccaacgcgttagaagccaaacaaaaagagaaaggaaacaagcacgggtctaccggctggcgacgcacggcagccagaatccgcgctgcaccccctttttttggtggaaagggtggggggcgtgtaaggggggggtgcgggagagggcagttacctacgttttaactgtagatggcgtctgaggcttttccaagatcgcgagctctccaaaaattaaacaaacaaacaaaaaaaagaaaaattgcaagggagcatttaacttggtgcggtcagcgctgcaacaaaagattgcaaaagctgggcacagagttgcggcgcgggctgggcgcaggtaccgcgacaaagccctgggctcggcccgccgcgcggaggtcagcacaggctcatgctgtcgccgctcgctcgcgccccaggtcttcctccgaatgcagccagacgtgcaggagagaacgaggacagatcggcggtctccgatttcgccggcacgagcttgcgggggtcctgcgggcgctgcaaggggagctgcgtaccctggcccttccaacgcgcggcgttcctttgcccctttcccgctggagaactggatctcgtcctggaataatttgcaatcaccccgtctccccctaccccgagaccaaattgcccggtggggtttgttttggagaaaattgacggcttgtctcctccttctttgatttcttgcttgccccccccagagaaaagaggggaccgtgtatttaaaaattaaaggggacggccgac

SEQ ID NO: 3672 - DNA, 2048 bp, Homo sapiens
  misc_feature (1)...(2048): n = A,T,C or G
ctcataaacttttacaaantagctttaaaggaaaaaggtttttttttttttttgtattatatttttattgttggcttaaaaaaattacttctttaacctccttaatttgtcagtttgtgggaggtgaatctcaatggcatcaaaagttatagtcttcttacacttgttaaaaataaagtgtttaaacaagtttgtttccattcacaaacttactcccaactacaaaaaaaaaaagaaagaaaaaaaaccagaatccatcctccttcctcattgtctcctaatggagagcagcaatcctttccatccagaccattgtcacacaaccgtctccacgcccatcagctttggtgtaaggattctcggtgtcacaccgttgtttaggtcttcctcgaactctagcaactgccccatgaagttaaggtttggggagataattggtcgtttgcctttgacaaatttataagcatcagtcatggtcatccgagtgtgcttcatcaagtaagcgatgacgatggtggcggagcgggacaccccagcctggcagtggatgagaagccccttcccacactggtgagcttcctcaatgaactcaaaagcctcttcaaagtactgccgcaggttctgcttgttgctgtcagtggctggcagccgcttgtagttgaacaggcctttctcatagtggtagaggggaagatgagtggtgacgttgatgacgtagccgatgttcagccgctgcatggtgtccaggtcctgagcatcctgctcattgccaaggaacaggaagggcaagatgggggtgagctcagcgttctcgatgtcaggggtggtggggatgggctgaggtagcaagctcgaggccgcggatgcgccgccccccacctcccggcactcttggagctggagggagttgtcacagaggttttcatggttctgcttaaaactactaagtccacctttcaacaccagaggttctttgccttctctcttcagggactcgaggactatgtgaagtggctgggagggcatcactcggcttggctcattggtattctcatcataaactataatttctttggaaaagatcctcttgaaagagtccttgccttccctacaggaaatcaagtctaggacagtgatcttgccctgctgcagtctccgccggctgatcttatcggcacagttaatgtggacagctccttggatgtgactcttgttgtactccatgaagggcctgcagtcaatgatgacagggccctgactcggcaggtgactcttgctgcatttggtcatcttctttgccaagtcattggggtagattattttgatgctggctagctgcttgggggtccctgacacagggctgcccaccccacttgatggacttagagagcctgtattctcattattgttgaccatctggttagcagggcaggtggtagaggttccgatggcagtggtggtggtgccagcggcaatggcttgggtctgggcctgattgtccttgtcgtaggttgccacagtgcagcagctggcactgctgcatccacaattcagcgagcgggcagagccgctggatgagggcatatacgtcagattcgcagccttgagggacacaacggtggtggcgatgacaggagggtggctgttactgcctgggttggcagagccaaggtaactagagtctaaacaaaggttgagatcctgaggtcggacgggcctagatagtgccactactaccctgtcgtctaaaggagacggaggcatgaggaggctgaaaactggcaattcaagaagaactcaagacagtttcataaataagtgtattcctccaccatctggcgctcctcttcagctatggactcgcacattcagcccccattcactcggcttcattgcggacgcgtgggtcgacccgggaattccggaccggtacctgcaggcgtaccttctatagtgtcacctaaatcgtaagggcgaattctgcagatatccatcacactggcggccgctcgagcatgcatctagaggcccaattcgccctatagtga

SEQ ID NO: 3673 - DNA, 3343 bp, Homo sapiens
atctcagtgattcagacacactgaagcattgcatttgaatcataattatgaaccatttaaaaattggggatttattttttaattatgaaaaattctgttgtaatagtaccacatccaatgtatatgttattagctgtttgttacccactatttcattatattggaatgagggcaaataatcctgtaggcaagcacgatattttaaaagttaggaattctgacacatgtcaatcaccttgttaaagagattgatatgctgctgaaagaatatttactctctggagacatatctgaagctgaacattgccttaaggaactggaagtacctcattttcaccatgagcttgtatatgaagctattataatggttttagagtcaactggagaaagtacatttaagatgattttggatttattaaagtccctttggaagtcttctaccattactgtagaccaaatgaaaagaggttatgagagaatttacaatgaaattccggacattaatctggatgtcccacattcatactctgtgctggagcggtttgtagaagaatgttttcaggctggaataatttccaaacaactcagagatctttgtccttcaaggggcagaaagcgttttgtaagcgaaggagatggaggtcgtcttaaaccagagagctactgaatataagaactcttgcagtcttagatgttataaaaatatatatctgaattgtaagagttgttagcacaagtttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgaattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaattaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgaccagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgtatataaaagttgtatttaatcccttgtgcccaagaatgctataaaagatcccaagaatgttatctataaaagatagcaataggaatggtgaacaaataatttaatttgcaattctaaaaacatgacttaaaccccataaaacttggttcatagtttaactgtttatgttcaatacaaaccagagtgtttacattcacaatacaaatttcatcaatcttggatatttttgtatttctatgaatactatcaattttattgataacacatactactttcagcacacagaagcatattttctagttattgttaaatagtagataaggcaggttgttccctaaagtgctcagttatcattcagtgggttatttgccgttgatccttttctgccatttcttgttggcgaattgtattctgtgctgcttgatgcattttctctagtttttccagagtcagagattttaagggtaaaagtttgggtttacacagcaccattgtcattatatcttccacaaacagtggcccttgctttggaagaacttcccggaacattgacttcacttctgccatatctgagttgttggatatagtgttttttcctgaaagttctggtctttttgctgcagctttaagcatccaacccggtattaccaagatgacttagagttcttgactcaagcatacagaagaaaagatgcatcccttcccagacggctcagctgttgccccgggtaacggtgagactggcgaaggaaaaaaaaaa

SEQ ID NO: 3674 - DNA, 1627 bp, Homo sapiens
ttttttttttttttttttttttttttttttttttttttttccaaggttcacggggtttattagggagtcgggagggagaaaacccaggagtccccaggccatccacattgctccccggcatgtgacgatccagcctggctttctctggtcctttctggacagaggctggccaagcaggcagcagcctcaaggggagtgggtaggagctgggggccttctggcagccctactcagaggatgatctggttggtgaagcttcggctcagctccttgtgtggcagaacaatcgagttcaggatgagcacctcggcagggatccggactcggcagcccaggatggtgatagcaggcagcagcttcccgtccttgaagaggctctcactgtccatgcgggctcggggatcgttggggttagggtcactgggggtaccctccacgcgggcccagcgtcccacggtgctcccccagcccacgatgctatgcagaacacacgtgtgctcctgcaaagtggctccatggaggacgatgctctcccggagccgcacaccctcacccacggtcacccccttcccgatggagacgttggggcccaagcacagccgagggggccaccttggcggtcgggtggatgtacacattccctcggatccatgggccccctggggtgtgcttggccagccgttctgggtgagtgtcctggtatcggctcaggtagaggcgggaggcgtagagggctgaacctgcggacttgatctgactccagataccatcagtgagatgcacgtatatctggccctgccctgccagggctgaaaacacatcctgctctaggcggatggtacctgcccctggccacaagcctggtgagtcctccaattgcccatcctgctgattacgctggaagacatcccgaagaggcttcaaggcttcaggagaaaagaggtagatgccgcagttgatgatgtcactgataaatgtgctgggtttctccacatagtgcaatacctcgtgtgtctgtggattctcaacgatgcagccgtagttgagggattgcgtcctgttagccgtagtgccaaggagtaagaaagggtgacgctggcgtcggtgggcttccaacatagcactcaaggggaagtcggagcagacatcagcattgagcacgaagaatgcctcggggctcccagccaggatctggtctcgaaaatggtaaagaccaccccctgtgcctaggggggcaaattcctgcaggtacctgactggaaggttaaactcctgctgggcggcttctaggaactgggtgaggggctcatcaggttggtagaagccaatgagcagaatctcctgcattccagggacctgggcacaggcttcaatatggtgttggatcatagggacccctgccacaggaaacaatggtttgggcacctcaaaagacaaaggtctgaagcgagttcccttttgagggcctccaatcaggatcaccgctttgagcataatggtgactgctacctaaacactagctcccttcactctgctcactggaaaaaaagcttgagctcgagtcctcaagccgaattctgcagatatccatcacactggcggccgctcgagcatgcatctagagggc

SEQ ID NO: 3675 - DNA, 1748 bp, Homo sapiens
ctaaattaaggctattaacacttttcatgaaatataggatacaaacttgttttaactttttcatttgattttttaacagtgttaaatttttctgagtgttaagtacagaaattgtttccctttatgatttttccattgtttttatgcttaggaaggccttgcccatctcaagataagttaactttcacttagattttaaaaatactaactgccctttgagtttaatgttttttagaactgttattcttgaatcaatatgtaatttatttgggcatatgatactgaggatagttcgatttaagatctgcccaaatagcgagttatctcgatgctgtgtcaacagggacattgtcagtttctctgagagaaatctttgtgccccgcccttctgtgggagtgccacttattgtatccacttgggcacagcatggagaatgtcttaaatgcaccagataagtctgaaacagactgttgctttgcaccattgagtcaaaaataagcctactaaattataagtgacagaatgtgaaaagcagaattgtgggaatcatatactgtgcctctaaaaaatactttatcaatgactttgtcttacagttcccagggagacaggtgatttttttgttttctgattcccatcatttatgcttcttctgaacaatttgtggtgcatctgcatcaaagttagatcagctgctatttaccttctgcaagtgctttatataagacatggaagaaaaaaattcagtgaccagagagagatagaaatgtacagggcagaattatttggagtcagctttttggaaagtattgctttgttggaggaaaaataaggcagctatcctgctggtctgggatgctttgcaacacaagtcatcttttgaatatcatagggttgtccttggtttcccatggagcaaatgaataaaatcagatggtaaattggtgtgaattattcatcatgtggtaatacaaggctgtaattcctacctctgacaattgcggcctgtgtcagttccattgtttgtgttattgtactttatgcaccctccagaattatctaccccctccccagtgtaaaccattggttggaacattctgcttcttagaaggcagcagttttgtcttctgcctcttttaacatattctgtctcttaggtctgaattctgaatagaaatcagaactttttcactcccttatgaagcatgttagtgggggatgcttaccttccttaatgaaacttgagacatgcagtcttctttgatttccatatatgattaataaatgttacattcataacaatttttccctcttattttcattaacagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaataaaaaaaaaaaaaaaaaatcagtttgtccttcctgactgttaatgactacctttggttgggggaaggaagaggccaatttcatgttctcttaaacatttctttgcatttggtttttgtgttcctgaacaaaatatgggaaagtgtctaacttcatggctatggccttttggagtctcatctgacataatgaaaagtaatcacttgaagagaattaacatatagcatcatgattttctcaataaactgatgtgtgacaataaaaaaaaaaaaaaa

SEQ ID NO: 3676 - DNA, 1396 bp, Homo sapiens
  misc_feature (1)...(1396): n = A,T,C or G
tggtctcggaaacgaaacgaaattcggtccctgggcctcctcccgggcgctgcggtccctcagcgcgccgncaacccggaacagacccttctcccgccattttcggcgggcntgggagactgaggcccgcgngcntgagctgcgcgccccggaagaggcgggcggcatgcntgngcggtggactgcggggacggggttggcgcccggcagcacgtgttcctggtttcagaatatttaaaagatgcttcaaagaagatgaaaaatgggctaatgtttgtaaaacttggttaacccctgttcaggaagaaggagccatttacttgttcaatatgtgtctacagcaagctgtttgaagtaaaagttttcaaggaaaaacaccattcttggtttataaatcaatcagttcaatcaggaggtcttctccattttgccacacctgtggatcctctatttctgcttctccactacctcataaaggctgataaggaggggaagtttcagccccttgatcaagttgtggtggataacgtgtttccaaattgcatcttgttgctgaaacttcctggacttgagaagttacttcatcatgtgacagaggaaaaaggtaatccagaaatagacaacaagaaatattacaagtacagcaaagagaagacattaaagtggctggaaaaaaaggttaatcaaactgtggcagcattaaaaaccaataatgtgaatgtcagttcccgggtacagtcaactgcatttttctctggtgaccaagcttccactgacaaggaagaggattatattcgttatgcccatggtctgatatctgactacatccctaaagaattaagtgatgacttatctaaatacttaaagcttccagaaccttcagcctcattgccaaatcctccatcaaagaaaataaagttatcagatgagcctgtagaagcaaaagaagattacactaagtttaatactaaagatttgaagactgaaaagaaaaatagcaaaatgactgcagctcagaaggctttggctaaagttgacaagagtggaatgaaaagtattgataccttttttggggtaaaaaataaaaaaaaaattggaaaggtttgaaactttgaaaataaaatctagcaaaaatattagctttttacatgtttcagtttgtccttcctgactgttaatgactacctttggttgggggaaggaagaggccaatttcatgttctcttaaacatttctttgcatttggtttttgtgttcctgaacaaaatatgggaaagtgtctaacttcatgctatggccttttggagtctcatctgacataatgaaaagtaatcacttgaagagaattaacatatagcatcatgattttctcaataaactgatgtgtgacaatgtt

SEQ ID NO: 3677 - DNA, 827 bp, Homo sapiens
  misc_feature (1)...(827): n = A,T,C or G
agctcggatccactagtaacggccgccagtgtgctggaattcggcttattaaccctcactaaatgctggggatacaggcatccaccaccacgcccggttaatttcgtatttttaatagaggtggggtttctccatgttggtcaggctggtctcgaactccngacntcagctgatttgcccgccttggcctcccaaagtgctggaattacaggcgtgagccacccacacccagccccccaagttttcttttctttgtagagatgggggtctcgctggtgttgcccaggtaggtctcaaactcctggtcctcaagtaatcctccngccttggcctcccaaagtgttgagattacaggcatgagccaccatgcccagcctccctgttttcaattcccctgttttaccattatgagctaaagaactctgactgcctgggtaaaacaaggacaatagtgtngtantagcatnggatagtcatgaagatagaatgcantaaagctataaagcatgtcgcattacagtaggtgctaaagttaatgctattttctctcacctcttccactaaaacccagagagttaatgacttagtgcttaactagtagaacttccggcaacagccaacttctctgctttgcacagacattacgaatgtctcagcatttagacacttactggcttaaagaaaaagcacctcagaggaattgaaacccagctgccggccatccccagcatttagtgagggttaataagccgaattctgcagatatccatcacactggcggccgctcgagcatgcatctagagggcccaattcgccgtatagtgagt

SEQ ID NO: 3678 - DNA, 572 bp, Homo sapiens
gtatttctatgaatactatcaattttattgataacacatactactttcagcacacagaagcatattttctagttattgttaaatagtagataaggcaggttgttccctaaagtgctcagttatcattcagtgggttatttgccgttgatccttttctgccatttcttgttggcgaattgtattctgtgctgcttgatgcattttctctagtttttccagagtcagagattttaagggtaaaagtttgggtttacacagcaccattgtcattatatcttccacaaacagtggccctgttatcccagcactttgggatgccaaaggggttggattgtttgtttgagcccaggggtttgagaccagcctaggcaacacattgagatcccttctcttgctttggaagaactttccgggaccatggcctcaactcctgccatatctgagttgtgggatatagtgttttttcctgaaagttctggtctttttgctgcagctttaagcatccaacccggtattaccaagatgacttagagttcttgactcaagcatacagaagaaaagatgcatccctt

SEQ ID NO: 3679 - DNA, 539 bp, Homo sapiens
tttatttctatgaatactatcaattttattgataacacatactactttcagcacacagaagcatattttctagttattgttaaatagtagataaggcaggttgttccctaaagtgctcagttatcattcagtgggttatttgccgttgatccttttctgccatttcttgttggcgaattgtattctgtgctgcttgatgcattttctctagtttttccagagtcagagattttaagggtaaaagtttgggtttacacagcaccattgtcattatatcttccacaaacagtggcccttgctttggaagaacttcccggaacattgacttcacttctgccatatctgagttgttggatatagtgttttttcctcgcttgcttgtatacccctccgattgtcttcaggcatcttgaaggatatgcaaatcctggtataaaggatggtgattgatacaataaccacgttgttctttgagatgttaatggactttctgataagattccatagttattaaatttgagaagccctgaaagttctgg

SEQ ID NO: 3680 - DNA, 497 bp, Homo sapiens
ttttttttttttttttttttttcagtatcgttgggggtcaacatatattcatcttctaaatgagaatattcaaagaagcacatacaccaatttattattaattgaaaagaccttagagccaatacagcatacagaaggtaacagaaggagaaatatgaggctggtagggggagggtggaaacagacgaaggaccaatccaagatcacagagggtatcgaaggcaaaaccaggggaaacatctccaggctccaggggcaatctggtagaacagtctggctgcctcctcctctctcagcttcttgcaggtgcggacgaaggaatgcatgtccccatagcttcgctcaaagaacacataggctttggtctcacccaggataatttcagtgatttggttgatgttactatgagcagacaggcaaaagcacggtgccagggattcctggtagcagctgatatcaaacaccttgcacaccagctcctctccgctgtgcagatt

SEQ ID NO: 3681 - DNA, 1395 bp, Homo sapiens
  misc_feature (1)...(1395): n = A,T,C or G
aatccnataagataatngtaaagttgatccagaaataatgatatggtaatgaataattcccctattagattgattgaaggggtaganctagattagcnagacttgctatccagtcatccattgggcnataagtgggaaagcccattttgaangtcctcggnccatgaattattgttccggccttggaatcccgttcnttagttgggagtttncctaggccagaattngggagttnatgaatntggaggcccatgtgccgattaattaggaatggttncctccctatgaagccttccatggagtttngattangattgatnccaattaccaagtgcttatntggcctaactgaggaagtaggccgatttagtgatttttaaatctgtttggcgtaagcagattgagctagttataattattcctcatagggagagaaggatgaaggggtatgctatatattttgttagtgggtctagaataatggagatgcgaattattccgtaactacctaattttagaagaatagctgctagaattattgacccagcaattggagcttcaacatgggcttttggtagtcataggtgaactccatataatggtattttaataagaaatgctattatgcatgccaaccatagtaagttgttagatcatgaagcgtctaaggtgtgtgttgtgaatgataaaattatgaggtttagggttcctacatggttttggattaagatgagggcaattagcagtggaatagaaccgattagggtataaaataggaaataaatccctgcgtttaggcgttcagtttggttccctcatcgggtaataataataagtgttgggattaaggttgcttcaaataaaatataaaatataattagttcagttgctgaaaaggttatgattaggagaatttgtaagctgattagtattgagatgtagagtttttgtagtacgttattatctttttttaggtggttttggctagctattaatattagtggcagtaatcaggctgttaaaataattaatggtgtggatagggggtctgaggagaatatatttgaaaagtttttataattttcgtcggtttgtcatagaagtgttaggctggttaaactaattagaaaactatatgaggttacgtttgttcaggtttttttagggcttgatagtcaggttagtggtagtagcattagtgagggaagaataatttttagcattgtagtaggttgagattttggacgtaatctgttccgtacgtgtttgaaacttttactaagtagggctangtcctacagctgcttcgcaggctgcgaaaactaagatcggttgatgggggattcggtatggagcttatgggagttggagtttagggaagttactgaagttagt

SEQ ID NO: 3682 - DNA, 592 bp, Homo sapiens
  misc_feature (1)...(592): n = A,T,C or G
cattccaaactggtagtggtatatagaattaaagataataatgttggcttcttattccaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcagggcatgtaaatatttgtctggagtcacagtattaatgaatgagatcttaaggcatctggtgacatcagaactctgtgtcagccacttttatttgtatattgaaccctaggctagtgccccaagctgcactattgggaatggattgtggctgaacagcaaatcaaaacaccagaaatatttttatatgttaacgtcatattatgttaatgttgctgaaaacaaaacctaacaaaccttgatgtaccagtccaataccatgtgcgctgagtgataaagttaaatgtgctgtgcttcccacccttgtcagagggagggtngcttgtgttatttnactgcttttgaagtncaggatggtttacttngtgcggttactgg

SEQ ID NO: 3683 - DNA, 551 bp, Homo sapiens
  misc_feature (1)...(551): n = A,T,C or G
cactcttgttgcctaggctggagtgcaatgatgcaatctgggctcaccacaacctctgcctcctgggttcgagcgattctcctgcttcaccctcctgagtagctgggaatacaggcatccaccaccacgcccggttaatttcgtatttttaatagagatggggtttctccatgttggtcaggctggtctcgaactcccgacctcagctgatttgcccgccttggcctcccaaagtgctggaattacaggcgtgagccaccacacccagccccccaagttttcttttctttgtagagatgggggtctcgctgtgttgcccaggtaggtctcaaactcctggcctcaagtaatcctcctgccttggcctcccaaagtgttgagattacaggcatgagccaccatgcccagcctccctgttttcaattcccctgttttaccattatgagctaaagaactctgactgcctgngtaaaacaaggacaatagtgtctactacataggatagtcatgaagatagaatgcactaaagctataaagcatgtcgcatacag

SEQ ID NO: 3684 - DNA, 505 bp, Homo sapiens
  misc_feature (1)...(505): n = A,T,C or G
ttttttttttttttttttttttttttttttggatttctatgaatactatcaattttattgataacacatactactttcagcacacagaagcatattttctagttattggtaaatagtagataaggcaggttgttccctaaagggctcagttatcattcagggggttatttgccggtgatccttttctgccatttcttgttggcgaattggattctgggctgcttgatgcattttctttagtttttccagagtcagagattttaagggtaaaagtttgggtttacacagcaccattgtcattatatcttccacaaacaggggccctaagtttaacaagaaataagaattaattcaagaaagataacccagttgtttgtagttggatttgcagctagaatgaaggtctaaaaaattaatctcttgtcactgaaaaactcttgtacctaaattgagttttgctctggaaccagaaagatcattgncattctataagcgcatttcttac

SEQ ID NO: 3685 - DNA, 460 bp, Homo sapiens
cacagaagcatattttctagttattgttaaatagtagataaggcaggttgttccctaaagtgctcagttatcattcagtgggttatttgccgttgatccttttctgccatttcttgttggcgaattgtattctgtgctgcttgatgcattttctctagtttttccagagtcagagattttaagggtaaaagtttgggtttccagcaccattgtcattatatcttccacaaacagtggcccttgctttggaagaacttcccggaacattgacttcacttctgccatatctgagttgttggatatagtgttttttcctgaaagttctggtctttttgctgcagctttcagcatccaacccggtattaccaacattacttagagttctctgactctagcatgcagaagaaaagatgcatcccttcccaagcggttcagctgttgctccgggaaacagtcagcc

SEQ ID NO: 3686 - DNA, 378 bp, Homo sapiens
  misc_feature (1)...(378): n = A,T,C or G
tttttttttttttttttccacgaatactatcaattttattgataacacatactactttcagcacacagaagcatattttctagttattgttaaatagtagataaggcaggttgttccctaaagtgctcagttatcattcagtgggttatttgccgttgatccttttctgccatttcttgttggcgaattgtattctgtgctgcttgatgcattttctctagtttttccagagtcanagattttaagggtaaaagtttgggtttacacagcaccattgtcattatatcttccacaaacagtggcccttgctttggaagaacttcccggaacattgacttcacttctgccatatagatgcatcccttcccagacggctca

SEQ ID NO: 3687 - DNA, 479 bp, Homo sapiens
  misc_feature (1)...(479): n = A,T,C or G
gttttgataagtaactttttaagtgccatgtttaggacctgatcattccaagtttcacgttcatgtatgactgcngtcntttctttcaaggacagtgttttttgtagtaaatcactggtttattcaaagctttagttaggggtgagtgaagctactaaaccccatgttggctgctgctgtggaaatgctgtgctttgagagtaaacacacacacacacacacacacactttttgttttaaagaatttttaaaaaaacgagttagtcatgagactttttcatctttccagggaacatattgattggtcttaaatattagacagttaagtaaatggtggctggaacatctatttttctacaaaactggaaaaacgaacccggttctacaagaatgtacctcggccgcgaccacgctaagccgaattctgcagatatccatcacactggcggccgctcgagcatgcatctagaggcccaatg

SEQ ID NO: 3688 - DNA, 482 bp, Homo sapiens
aaaccaggatcccagacccacacaaatggcccccggacaggacaatcaacctggtttccccggccctttcggaaacagcctgccaaaccagcgcaaccctcaggggaagggctaggacctggggccctctgcaagccctactcaggggctgacctgctcggtgaaccttcggctcagctccttgtgtggcagaacaatggggttcaggatgagcacttggcaaggaatccggactcggcagccaaggatggtgatagcaggcagcagcttcccgtccttgaagaggctttcactgtccatgcgggttcggggatcgttggggttagggtcactgggggtaaccctccacgcgggcccagcgtcccacggtgctcccccagcccacgatgctatgcagaacacacgtgtgctcctgcaaagtggctccatggaggacgatgctctcccggagccgcacaccctcacccacggtcacccgtcga

SEQ ID NO: 3689 - DNA, 472 bp, Homo sapiens
gaagcacatacaccaatttattattaattgaaaagaccttagagccaatacagcatacagaaggtaacagaaggagaaatatgaggctggtagggggagggtggaaacagacgaaggaccaatccaagatcacagagggtatcgaaggcaaaaccaggggaaacatctccaggctccagaggcagaggcatctgagcggaagagaaaaggtaaatgtggttccacactctaaatcttccaacagctgccccttctcagtttgttaataaaggtaaaggcattcacaagcaaagatcaagatatgagctggtctccacattatgtggggcctcattcaggaactacggtgagcaatgaatacagatttgttgcctctgtccctctaaactcatattcttaaaaagaacaaaaagggcttgaaaggagttcttgtaatccaaatcggctgggagagaaagcagggcccccagca

SEQ ID NO: 3690 - DNA, 618 bp, Homo sapiens
  misc_feature (1)...(618): n = A,T,C or G
gtgattctcaacgatgcagccgtagttgaggattgcgtcctgttagccgtagtgccagagtaagaaagggtacgctgncgtcggtgggcttccaacatagcactcaaggggaagtcggagcagacatcagcattgagcacgaagaatgcctcggggctcccagccnaggatctgactggaaggttaaactcctgctgggcggcttctaggaactgggtgaggggctcatcaggttggtagaagccaatgagcagaatctcctgcatttccccagggaccctgggcacaggcttcaatatggtgttggatcatagggacccctgccacaggaaacaatggtttgggcacctcaaaagacaaaggtctgaagcgagttcccttttgagggccaccaatcaggatcaccgctttgagcataatggtgactgctacctaaactctgtatgttgaaccccaaatcaaaagacaggttcccttggcatctcaaacactgaacctattgacccccctnnagtcctaatacggacgactgggtctaaatctctggattcggaggattgattgattgctgaccctctgaaccccacaactgactctgtccaataaaccctggcctct

SEQ ID NO: 3691 - DNA, 405 bp, Homo sapiens
  misc_feature (1)...(405): n = A,T,C or G
cattccaaactggtagtggtatatagaattaaagataataatgttgcttcttattcaaactgttggtcatatgtacagtatataaacataaaacacacaaggaaggtattatgtatgcagtagtatactagagtttaggaaaatgaaaattttagaaaatatgttttgtcaccctgttggtcagaaagatgtctttctggttttaacgcatgcaggcatgtaaatatttgtctgggagtcacagtattaatgaatgaggatcttaagcatctgggtgacatcaggaacttctgtgtgcagccacttttatttgtattattggaacccctnggcttggtgcccccaggctggcacttttggggggatgggggttgtggggcctggaaccagccaaattcccaaaac

SEQ ID NO: 3692 - DNA, 451 bp, Homo sapiens
aggttcacggggtttattagggagtcgggagggagaaaacccaggagtccccaggccatccacattgctccccggcatgtgacgatccagcctggctttctctggtcctttctggacagaggctgggtgagtgtcctggtatcggctcaggtagaggcgggaggcgtagagggctgaacctgcggacttgatctgactccagataccatcagtgagatgcacgtatatctggccctgccctgccagggctgaaaacacatcctgctctaggcggatggtacctgcccctggccacaagcctggtgagtcctccctggcagagaggaagaatgctgacattagtcccccagctgagccccgactgtggggctaacacagtctcccagggacaggagtaggaggattcccaccacctctctaagcccctctctccaggtctggttcggccctc

SEQ ID NO: 3693 - DNA, 493 bp, Homo sapiens
tcccccaagcctatatccgccccctatggggaaagcctggaacccctcgagttccggcccgaaattccggggtcgactactcctacaaatttccgccccgtcgactttctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtatcgattcttaaaaaaaaaaaaaaaaaaaaagtcgacc

SEQ ID NO: 3694 - DNA, 433 bp, Homo sapiens
cccgggctcgcaggaattcggcacgagtgtaaaaagtaagccctttgctgggtctgctgtcccattcgcctctgtagaggtctaaattatacatgttgggtttttttttaatggattgatgttgtgtcaaagtgacatttgacaccacttcactgctctaatgttgcagaaaataaagttatcagatgagcctgtagaagcaaaagaagattacactaagtttaatactaaagatttgaagactgaaaaggtatgtgggttcaggtgtagtggtgtttcgttcatactcagtgccgtgatgtgcatgaatacatgaggaacagttgcacgcttgattgtgattacagttttgaccaggaagaattattaacttgcatttctgtgacttaataattaagaattgcatatgacaatgaaaatgttaagcaactaa

SEQ ID NO: 3695 - DNA, 383 bp, Homo sapiens
  misc_feature (1)...(383): n = A,T,C or G
ggcatggtggcgcatgcgtgtaatcccagctctggtgggggggggaaaaggggnggcncctttttttnnaaaggggggccccacgggaagaatttgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtctcttcatattcatatttaatccacatgtaaagttca

SEQ ID NO: 3696 - DNA, 405 bp, Homo sapiens
  misc_feature (1)...(405): n = A,T,C or G
ccaaccatagtaagttgttagatcatgagcgtctaaggtgtgtgttgtgaatgatanaattatgaggtttaggttcnaacatggttttggattaagatgagggcaattagcagtggaatagaaccgattagggtataaaataggaaataaatccctgcgtttaggcgttcagtntggttccctcatcgggtaataataataagtgttgggattaaggttgcttcaaataaaatataaaatataattagttcagttgctgaaaaggttatgattaggagaatttgtaagctgattagtattgagatgtagagtttttgtagtacttcggccgcgaccacgctaagccgaattntgcagatatccatcacactggcggccgctcgagcatgcatctagaggcccaat

SEQ ID NO: 3697 - DNA, 368 bp, Homo sapiens
gaggattatattcgttatgcccatggtctgatatctgactacatccctaaagaattaagtgatgacttatctaaatacttaaagcttccagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattggaatgtatcttcaaattcagatttaataaacatgtaaagatcctctgtaaa

SEQ ID NO: 3698 - DNA, 303 bp, Homo sapiens
ccgttgatccttttctgccatttcttgttggcgaattgtattctgtgctgcttgatgcattttctctagtttttccagagtcagagattttaagggtaaaagtttgggtttacacagcaccattgtcattatatcttccacaaacagtggcccttgctttggaagaacttcccggaacattgacttcacttctgccatatctgagttgttggatatagtgttttttcagatgcatcccttcccagacggctcagctgttgccccgggtaacggtgagactggcgaaggaaaaaataaaaaaaa

SEQ ID NO: 3699 - DNA, 360 bp, Homo sapiens
ttttttttttttttttttttttttttatttaaattcgcacaattttatttgtattgatgagattatgatattttcattataccaaatttatgtttatagcactagaggccatagttccccaccattcatgtcatcaacctctcctcctccaaggtacttaaaaaataggggagaggggaaaaaaaaggtccttcttgacacagtaccatcttcagaatgttaaaaaaaaaaaaaaaccttctctcctttctatcttccattagcaaaatagaatcaagggcaaatccatggccgccttgtctcctggttacgaagggtgaagccgccctcctgggaacgttaggacagggctcctgctgc

SEQ ID NO: 3700 - DNA, 288 bp, Homo sapiens
  misc_feature (1)...(288): n = A,T,C or G
ttcatatttacctcatgggctttatcaagcccatattacctcagcttatatatatttaccatttttaggtttttaattgtttgacacttggatgataaatgcagtcattttattctcaagtncttaaaattaatgtaattaaangcttagctgactacagaataggtgagggtttcttaaaaatgagatttaagggctgggcacggtgggctcatgcctgtaatcccagcactttggggaaaccaacatganggaaaccctgtctctattaaaaatacaaangtagcc

SEQ ID NO: 3701 - DNA, 306 bp, Homo sapiens
gaaaacccaggagtccccaggccatccacattgctccccggcatgtgacgatccagcctggctttctctggtcctttctggacagaggctggccaagcaggcagcagcctcaaggggagtgggtaggagctgggggccttctggcagccctactcagaggatgatctggttggtgaagcttcggctcagctccttgtgtggcagaacaatcgagttcaggatgagcacctcaaaagacaaaggtctgaagcgagttcccttttgagggcctccaatcaggatcaccgctttgagcataatggtgac

SEQ ID NO: 3702 - DNA, 315 bp, Homo sapiens
  misc_feature (1)...(315): n = A,T,C or G
aaagctaacacgtaacgaaaaaataccaagtttttaatttttttatatattgactatagtcagaatttgtatctgttttcatgtctttttttttcttcattacaggggcagaaagcgttttgtaagcgaaggagatggaggtcgtcttaaaccagagagctactgaatataaganctcttgcagtcttagatgttataaaaatatatatctgaattgtaagagttgttagcacaagtttttttttttttttttaagcacttgttttgggtacaaggcatttctgacattttatnaaacctacatttaaaggggga

SEQ ID NO: 3703 - DNA, 249 bp, Homo sapiens
  misc_feature (1)...(249): n = A,T,C or G
gggtgnatgtacacattccctagaagcagaagagaggccctgggggcaaatatcccaaaccgaatttgatcaggaaggggcagggattgaggctttaactctggactcgaggtcaanaatcctggttcagagggctggggtggaanncaaaggttaggaattggggcaggctgggtacctcggatccatgggccccctggggtgtgcttggccagccgttctgggtgagtgtcctggtatcggctcagg

SEQ ID NO: 3704 - DNA, 267 bp, Homo sapiens
  misc_feature (1)...(267): n = A,T,C or G
tggggacaggggctccagtggagtaggngtgaagcatccaagagtccgcacacacatgccacatactagagtgaagcacagattcaagtaacatttacacactagagtccacgtgtcacctacccaaaaacaggaccatttcacaaaacagatgcaggcaggaaaacccaaacgactgaggtacntcggccgcgaccacgctaagccgaattntgcagatatccatcacactggcggccgctcgagcatgcatctagaggcccaatg

SEQ ID NO: 3705 - DNA, 226 bp, Homo sapiens
ggcgtccggcaaaaaaacgtccattcaagacttttctaggaagctgttgttaggagcagtccatcacagtacccaggtctggacaggatgagacctacctctcttcgtccttaaagatgaatttccgcagcttgaggtcccgcagcaccagccccccgtcaatgcagtggccactccgaggaaaactggtagaacagtctggctgcctcctcctatctcagcttct

SEQ ID NO: 3706 - DNA, 163 bp, Homo sapiens
  misc_feature (1)...(163): n = A,T,C or G
atatctgagttgttggatatagtgttttttcctgaaagttctggtctttttgctgcagctttaagcatccaacccggtattaccaagatgacttagagttcttgactcaagcatacagnngaaaagatgcatcccttcccagncggctcagctgttgccncgg

SEQ ID NO: 3707 - DNA, 156 bp, Homo sapiens
gatgtctttctggttttaacgcatgcaggcatgtaaatatttgtctggagtcacagtattaatgaatgagatcttaagcatctggtgacatcagaactcaagccgaattctgcagatatccatcacactgggcggccgctcgagcatgcatctagg

SEQ ID NO: 3708 - DNA, 80 bp, Homo sapiens
  misc_feature (1)...(80): n = A,T,C or G
aagaatgctgacattagtcccccagctgagccccgactgtggggctaanacagtctcccagggacaggagtaggaggatt

SEQ ID NO: 3709 - DNA, 13 bp, Homo sapiens
gtcaccctgttgg

SEQ ID NO: 3710 - DNA, 703 bp, Homo sapiens
  misc_feature (1)...(703): n = A,T,C or G
cttcttcagctctctcttgcagttttttcttatatgcagatgtcacaaatgcttctttatcatcaaactcccccttttccatttctcgttctctctgtattttcttttccattcttttttcctgttccttttttctgatctcaactgcttttagcaagttgtgaatatacttgggctttctgtctttccccaaaagcaatttgggattattttcctccttttttttctgcatttcatcataaatactgtcatattcatacacagtagcatcttctgcaagggccttctggatttccagtttggtctgtttcatggcctgcttcttagcagcttccctctgaaggctttcactcacagaggtcctttttctgtggcttctcagaacaatattcctaaaacgagaaggaagggcgggaatcaggacttgagcttcttgcccaggagaacaaggccctctaaggaagccaggaactgtctctcttcacactgcccctgagagcatccaagcggggagaaactcaagcgcgggttaggaagcaagactgaggggcctcagaccgagcttttggaaaatagaaaagtctcgctctctgcccctcagcctaacttcctttatttcctcacaagtttctccctcaaacttcgggcttccatccgggaaaatgtacgggggaggggaatctatgttcctcangacttctcg

SEQ ID NO: 3711 - DNA, 558 bp, Homo sapiens
tttctttctttttttctttctttctttctttctttctttctttctttctttctttctttctttctttctttcttttcttttttctgatctcaactgcttttagcaagttgtgaatatacttgggctttctgtctttccccaaaagcaatttgggattattttcctccttttttttctgcatttcatcataaatactgtcatattcatacacagtagcatcttctgcaagggccttctggatttccagtttggtcttaaaaaaaaaattaaacatgtttcaaaaatatgagccagccaatagatacaacaaagtctatgttttttgagaatggttcataaattgaaaatatatcataaaaattacaatcacatttttagataggaaatacaaataaactctggagccaggctgcctgggtatgaatgctggctctacacttactaattactccgggcaagtttgtttgtaatcttttggtaccttaatttcctcatctagaagagaaagaataatgactatatttacattctaagctgttataattaaatgactaaact

SEQ ID NO: 3712 - DNA, 265 bp, Homo sapiens
ctgcatttcatcataaatactgtcatattcatacacagtagcatcttctgcaagggccttctggatttccagtttggtctgtttcatggcctgcttcttagcagcttccctctgaaggctttcactcacagaggtctcatcatcatcatcagaatcattcccaaacactgatggtttttgcaaaacagggtgcaactgctgtgttttctttggcaaaataagcccatactgcctgcccggaatcgccatcttgctcccgtgtccc

SEQ ID NO: 3713 - DNA, 540 bp, Homo sapiens
gttgcctgtgctctggttatcatatttcaagaaatcatggccaactccaataccatttagattttgttttcttccaagagcctcggtgttttagttcttaaatttaggtctttgatccattctcggtgaatttttgtatatggtgcaacagctcttctctaattttctgttcattggattgtccactgttctattggattgtctttttcattctgctttgtatgtatctttttatgtatctttaatgtatcctgttacatgtcgcaagtattttctcctgtctgatacttatctttcaacctttgtttattgtactttttataaaggagttttaaatgtctatgtggtcaaatttattaatttttaaaaagacaaatccattttgggtcttgatgaagactttccttaccctcaaattacaaacaatatttcctaatattttttatcagttatttcttcattaagttgactaaacctagttaaatttaatgactaagactaaattcctacactaagttattcgattattcaataaatatt

SEQ ID NO: 3714 - DNA, 4476 bp, Homo sapiens
ttttttttttttttttttttttttttttttttttttttttttttccggaacacaagtttatttggcatttggatgaaatgattctcacagcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctagaggaggaggacccctggagcacaaggttcagcaagggtgaccccgggacttgctggtcagactggggactgcagcaggccttgcaaagggggcattctggatggtggtgcaagaacagatgagcgagtccagctctcctcatgctcccaagggcctcctggagccacagtggcagcggtgttccaggcagccctgccatgtggaccttctgcctggcccaacgtgccagtggcctgagtgcttgtggaggcccgagtgcttgtggaggcccatggggaaggggccacccagcaaccccggccagcccaaggcccaccctctgcagcctgcatggtccactttaccccgtttcctcactgccccctacgtgtctgaccggcccctaatgttcctctggtccccaaaggaagcgtcccagtcccacacatctcgtgccagccaccctgtcccgcacacacagttctgaggcctggcaggaatcctctgagctctcaggctcaggcccgtgggggactctgctgcgtggtcctcgggccctcactggccacctggcacccataatgcacatgcctgctgctctggaacctggctgccctgccccagtgcatgtgggatccacggcatgcttcctgcttcgtcctctgcagccagtaggggactcttgtggccaggacttccttgttaagtagcagcccttctccaaggggagcacaagcctgcccgcacacagcctccagcatcatgctccagcaggccaagctcagggacaggcaattcagtaacaaaactcacagctctggacagttctggcacaaaggtcaagtctgtctgtgggcaactcaagattctcattccacatgggatggaaaaaatgggtctccagccacagtgtgagaatgtgtcaagaagtggactgtgcatggagtccatccccgagcagcaccacagaactgcatgcttcagacaggcctcccaggtgctgccccgctggtctggaaagactgagcgagacagcactgcctcagcacagcccaggatgcatcgatgaccctggaagagtgggcccccagtgacccgtgaagttccatgtgccaccctcacctgcagacgcttggccacatacacacacagagacacaaacatacaaaggaaagatccagacattcaacgtagaaaagatatggatgtgctaaaaatcgcacagaacccgcttaatctccaaacctcagaaatgttaaaggccctgtgtcaggcaacaaaaccactgcccaggagcaggcaacagggtccgtcaggcaaaagggtgccaggaagggcccccagcccctgcgctgctgaggaggggccgggaggtgtgcatgcggccactgggcactgagctgcagtagtggcggtgatgtaaggagtggactttaaggagatagatgcagcccaggatggtggtttcagccacccctcctgcaatgaagcaaccctttatggcacaaatggggccgggggcaggcccaggggcaattcaacaggaggcaagagcccagggctccagagtggagagacaggaggcagctcagtccccagaccccagcagagcatctggggcctcggccccactccagagcttcttcctgagggagccatgcacagcaatgctgggagagggactgatggggtggggtcaggcctcctgccacagagctgggctgcagagcccagatggaaagacacagtgaagagctcaacctccttccaagctctccttctcagggcttcaggttccagagccccaggggagctcccagccaggggcagggtcaccttgatattcacaactgggcttgtgggggccatcttcagtgcaaccgttgtgacaaagtcaagaggctgcctccctgaagcagacccactgcctacgccacactgacggtccagaggccccctcctgagggcggccagcaaggggcactgtggcagctcccactgtgcctgtcccagactgggtcagcaggtctctctggacagcacactgcaccaagtaggcccaccaaaaacgcatcaggtgtgccatggcccacagtaccttcttcattccctgcctctaacatgtgcggtctgaatgaattttgtcactcttctgccatttataaaggagaagacagtgatccaaagctatgcatgtttctgaagccctcaaggaagctcggtgcaggccatcacttcttttggcagaaggcgggctgtggtctctatgtacacacgcgagcccgccagtgacgtgcggcagtgcgtggcgtccaggctgggacaggggcctttcaagtctccccagggaccggtgttttctgcaacagacaggtgctcccagaccgttggggtacaggccaggccgtctacaccacagtattgagggagctgcggctgtggcggccaccccctggcagtgcctctgcagctggggtgctcccgctctgggcagggtcagggggcacgagcagggcgctgctgctgtcggcagagtcttccaggtctgccagagaggcccccgcagtgggcagaggctgctccaggcgccggagtaatgcaccttcactcccaccatccccaggggctggcaggctgacctccacaggctcaaaagcatcatcgtctgcagggtcatagaacacactgtccgggtggatggaggcctcgtagggcggcggagggtcgtcgggctggccgatgtccgggtacttgtatgccgtgtagggaggtggagggtcgtggaaatggaaagtcccaccctctccgtcgtcagaaagatgcagcggcgtgaggcccgtgccaaacccgtctgggccgtaatcaaagccagggatcctgcggccgaggttgaagtggtgcaagtttgctccaatcagggactcgatgcgctcccggcgccgctggcgcagccggtggaccatgaagagcagcagtgacaggatgaggaaggaggagatgcagctgacgaccaggcgcatcccgctggccatggagtcaaacagactgttgccatctgggtccagacacatgaacttgcagcactctttggggtccttgcggtactgttggcagccctggggcctctcacagagagcagccacacacatctcaggctcccctccatggcaggtgcagctcaggcatgggtcgtcccccttaggggtgaagtagaacccttcatccaccacgttgtccttgatgtcaacacatgtttgacttcttttacacagaaatgaagacttctcgtagcagctctcggcgtgccagctgtggaggtcgtggtgccgcagggtggggaaatggaagcactgaagctgggcacagaacacgttgtcgttctcagacatggccgaggcaaagatggggtctgggggcaggaacacctctgaagagcctttgaatgccacctcccagcgaccttccaaggagcggttccggccagtgataacatactgatagccaacccacaacttgcgctggtccttccaaccaaagctccgctcgggctggtcccattcctgggccaggacaaagcgcagctcctggtcagtggagaaggtggcgagagagccattcaggcgctggcaggtctgcgcggcatcccagtagttctccccgctcaggtagacccggtagcagctggccgtgccttcgtagtggtgccaccctgtcgggcacttccctaggaaactgctgaagcgaacgggctgcgccacgttcaccgcgtggaagtgcgaagggtcgcctcctctggcccgcccctgccgcggatccacagcctccttcccatgatgaggacgcacctccccggtcacttctggacagttggcttcgtcgctctcatcctcgcaagtcgcccagccgtcacactgccaggggagggggatgcactggatggtgccgctgcgacacgcaaactgcccagggttgcaccgcagctctggccgcagcggctcggtgacagtgagcacgagcaggaagagcagcaggaaggcgccgctgtctgccttgggcaccatttatcctccgttcatcgtccccggggcggctgggaggccggaccgggccggactgagggtcaggggaccgtgccaagcggagggtcaggcggggctgaacctgggcgaggcgcggagaggcggcgggaaagagcttcggctgggccgcgggctggcgcacactctcggctgcaacctcaggcacc

SEQ ID NO: 3715 - DNA, 2468 bp, Homo sapiens
gttgtttgcctttttatttggccaaatccatagcgactataactaaaccaatttttttttttttttttttttttttactttcttctggaggtttattttggataaaatagttgaagacagactacaatgagacattgtaaaataagactagaaaataatttaagagcgtattttaagcacgggattccgacacactcataaacgtgtttgctcccagctcttacaaaagaaaataaggtttttctccatcaaaaacaacccagttacaccagtaaatcttcccagttctgaaaatctgaagcaactgatactccattaaatgtggaaacactgtctactcaaaatatttgtaatattatgcagtgacaaaaatttcccacacctatatagggttaaccatagttttcagcaaagcaacaagtgctttacttattttgtctttttcagtttatacagagctccaatttcatgaaaccatactgtgccaaaccaggaaataaacagcaacactctagcgaagccacgccaaccaaacggatactatctcctgtcctttttaccagctttcctcttcccagacagcaagtgcttgggcttcatatcaaacacgtgtctatccgcctcccctttcttccccaaccgattcatcttcttctgagcattcttcatcatagtcttggctttcttcaccatcttgacatccctaagaccagaaacgtcacgtggagttcgagagcaactcccactccgggccacagaggacgggggagcagagtcttcccgctttcttttcctagtgatgctccgggatcttcttgcctggactgcgtaatgggcatcgtctttatcgtccatgtcaacaccaagactacgcatctccttctccaaaactgtcctctgaaccttcttagcagttcgcggcatcctgggtccctgtgtattcttttctttggactccagaattttcaacttctttttctctcgaatttgctttgccagctgtcggatttccagcatctcttcgtcttcactctcagatacactgtcatactctccagcagctgttctcagctcttcttctttttctaattcttccaatttcttcatgatggctggatcaatataatcagctatattatggccttcccagatttctggtatcttatcatgtttttcagacaaattcattaaatcccagtacttctgaagatccaaaatataatcatctcccatttccagctcaagatctcgttccctcttcttcctggactcctcagtttccatcctcttcctgcgagccaccactccttcagggatgaaagggggcctctccttatcgtccctcctggttgggatagccaggtgcagtctattcagcacctcattcactttatttcccttcattttggtttccactcgatgagccaaaagcctatcgcaagcctctgttttaactttaataacaccttcctcagtcagggtgctggtctctattacagggaatccttcagactgcaaatctgtaaatattttctgatcatcttcagaaagttcagctattctcttcacatcacatttgttggctacaactatgagaggcttgttgatgaagagaggtctgatgttctggaagagttctagctgctccctcagcccatgcccacactgctcagacaaatccatcacatacaggaccgcagcacggaggtgggccagggcagtgatggcctgcatctcgatggtgttcctatcctccagagggtggtccaggatcccaggagtgtctacaacctgccaacgtagatacttataatccatgtgcccaacaaacagagacttggttgtgaacgcatagggctggacatccacgtctgctctcgtcaccttgttgatgaagctggacttcccaacatttgggtacccacacaaaagcagggtcctggtattcggatcaatggttggcaaacgggataaatgctgacgcacttgctccaaatactccaaactctgcttctgcctcttgatcactgtgcacatccgtcccagggccgcacgcttcagctgtttgcagcggtagagagagtcgccatacttcatcagtcgcacataatctttagcaacattgtccactaaatttttggcaatatttatttgccccagagccaacttgtaatgatccttgtcgtagagaatattcatcaaatcagcatagaacggatgaatatcatccaatttggggaaatctgttagaatttgtgaaagtctatcatggtaattctgttgagtaaatttgacttttctcatgtaaaaatgtctaatgcgatgtatttggtaatgtttatgaataacggttggagtctttcgttgagtcttcgacaacgtgaggtctatgaagtccttggcggacggcaccaccgtaattttcttgaagttgtaatgtgccatgccggcaaccgtatgcacgcggg

SEQ ID NO: 3716 - DNA, 1848 bp, Homo sapiens
tttttttttttttttttttttttttttttttttttaaaatacaaagaaaattttatttgtatatcaaagactctaagaaatgatgacataaggttaacagagttgatgtcaagacaaataggtttgaagttatagatgataaatcactttgtcttactgaaccttcccttgattacgttagagagcatccctggtatgctcccagttgaatcttaagcatgatgtgtgtccgggtgatataatcgtaattcctttctgttaatcctcgttctctctcttttttttctttttcttctttttctctggactagcaattgctgtgctggtacatggttcttcctcagaaagtggttcttccttaatgtgtttctttttaccccttttcttcttcttcttcacagatgtttcttcttcttctgccactttttcttcttcctcttcttcaactttaactttaatcttggcttttttggctttcttttcagtaatttcatcctctttatctacctgttctattttgcgttttttagaacaggttggaagtgtggagtcaccagaaggatcgtaagtcttcacttcacttttgtgttcatatttttctgtttttgctaatgcttttcctgttccacttatttttcttatccctctgtcttccaaagttctcaacctggcctctaatttggctctgttctcaactcccattgcagaacttgaatcctcaccaaaagcatcataacggatagccaaaacggttttggctgccagcattcgagaaatctttcctttgtgtttgggacttgtctggcccacgagtgaagcatgataaatgagaccatacttaggggtatcccgtctagatttgagggctctgaaaagtgccttttcagctccaagaatctgaacggtagaagctgcatgcttggccaaatttaaaagagaacctgcatgagcaataagccgtgctccaactaattccccaaccatgactgtaacattgggtgcaatggccatcattcgattttgtagatattcatagagctgggttcgatattcagagatttcaatcacctgggtgcaaagatgcagaatattgcaaatatcttcttctgaaacctctgttcccattgatatctctgcagctgctttcacttctgcttcaacttcttctggcagcaactcagaaagcttggcagaggcatagttcttcctatcgccaactttctgtaaacacttgcagtatgttaaattatctgaaataatttttcctaattcagggaaatgccagccataccattctctacatcgcataatgtagttgtttagttctttatccaagtcatctaacaaggaaattgcctgaacaatcattgtgtctactttatcagcgctaaacttcaatctatatcgagacaggctgtgagccaatccaagacacatagctgccatttcacgtggttctaccccagggattaatccatccatttgtgaacgaattcctctcataagttcattaacaacaggactatggatacaactgagattcagcttttcctttatgacccctcctagtttagcatcagctactgccagcggttcatgggcttcttttactattttcttcagaacttttttcagctgcttattgattttgccctccatcagagctgtgaatgctgctaatgcttctgctgtatcctgaaatttctcaaaatgttttagctttactattttgtttgctttctctggagtttcaaattctttccataaactatcaacctcttgaagtttcttctcatttagaaccttaaagatggcgtaacccacagacgtttcaaacagcaccaacat

SEQ ID NO: 3717 - DNA, 625 bp, Homo sapiens
tttcttccggaacacaagtttatttggcatttggatgaaatgattctcacagcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctaaaggaggaggacccctggagcacagggttcacaaagggtgaccccgggacttgctggtcagactggggactgcagcagacaggtgctcccagacccgttggggtacaggccaggccgtctacaccacagtattgagggagctgcggctgtggcggccaccccctggcagtgcctctgcagctgggggtgtcccgctctgggcaaggtcatggggcacgagaagggcctgctgcgatcgcagagtcttccaggtgtgccaaaaaggccccgcagtggcagaggctgtccagggccggagtaatgcacctcactccaccatccccagggctggaaggctgactccgaagcgtcaaagcatcatcgtctgaagggtcatagaacacactgttccggtggatggaggcctctagggg

SEQ ID NO: 3718 - DNA, 581 bp, Homo sapiens
agcggccgccctttttttttttttttcatgttgtttgcctttttatttggccaaatccatagcgactataactaaaccaaaacatgagctaagtaaatgaaaactactttcttctggaggtttattttggataaaatagttgaagacagactacaatgagacattgtaaaataagactagaaaataatttaagagcgtattttaagcacgggattccgacacactcataaacgtgtttgctcccagctcttacaaaagaaaataaggtttttctccatcaaaaacaacccagttacaccagtaaatcttcccagttctgaaaatctgaagcaactgatactccattaaatgtggaaacactgtctactcaaaatatttgtaatattatgcagtgacaaaaatttcccacacctatatagggttaaccatagttttcagcaaagcaacaagtgctttacttattttgtctttttcagtttatacagagctccaatttcatgaaaccatactgtgccaaaccaggaaataaacagcaacactctagcgaagccacgccaaccaaacggatactatctcctgtc

SEQ ID NO: 3719 - DNA, 678 bp, Homo sapiens
  misc_feature (1)...(678): n = A,T,C or G
cagnnctcaacagtcntgncccngaaccaaantataatcatctcccatttccagctcaagaactcgttccctcttcttcntggactcctcagtttccatcctcttcctgcgagccaccactccttcagggatgaaagggggnctctccttatcgaccctcctggttgggatagccaggtgcaggctattcagnacctcattcactttatttccctncatgtgggnttccactcgatgagncanaagcctatcgaangcctctgtnttaactntaatancaccttcctcagtcagggtgctggtctctattacagggaatccgcagactgcaatcttgnaaatatnttcttgatcatctgcagaaagtcagntattctcttcacatcacatttggtggatacaactatgagaggttggntgatgaagagaggcttatntcttggagagtcttgctgttcctcaagccatgncanagtgctcagaaaatccacaaatnaagattgaggaanggggnggcaagggaggnccgccnnatntggtggggcccntccccagggggcggnnnnccagggggtttnacccaaannnggnttttttttccnggcccaaaanaggnttgggggaannatgggtgaacccntttttcnaccgggngngtgttccaaatggncccnaacc

SEQ ID NO: 3720 - DNA, 473 bp, Homo sapiens
  misc_feature (1)...(473): n = A,T,C or G
ggcataagacaaggtcttgctatgttggccagggtggtcttgaactcctgagctcaagcaatcctctcaccttatgctctcaaagttttgggattacaggcatgagccactgtgtctggctgagggacacatctttattgctgccccatactccatgtcaccaacaccccacacatggaggcatgcactaaatgcctaatgaactgcacagctcanaatcttcccatattctgccagcagacaatgaagtgtcagaagttctccaatagggaaggtttttctcccttcttgatccatctgtcaagccgggtctattctggaagcaactgaagatgtggatcactcattaacactggcacctactctgtgccaggcagttctccaggtgacagggctggccgcagcggctcggtgacagtgagcacgagcaggaagagcagcaggaaggcgccgctgtctgccttgggcaccat

SEQ ID NO: 3721 - DNA, 456 bp, Homo sapiens
gcacgagctcaggcatgggtcgtcccccttaggggtgaagtagaacccttcatccaccacgttgtccttgatgtcaacacatgtttgacttcttttacacagaaatgaagacttctcgtagcagctctcggcgtgccagctgtggaggtcgtggtgccgcagggtggggaaatggaagcactgaagctgggcacagaacacgttgtcgttctcagacatggccgaggcaaagatggggtctgggggcaggaacacctctgaagagcctttgaatgccacctcccagcgaccttccaaggaggggagcctgagatgtgtgtggctgctctctgtgagaggccccagggctgccaacagtaccgcaaggaccccaaagagtgctgcaagttcatgtgtctggacccagatggcaacagtctgtttgactccatggccagcgggatgcgcctggtcgtc

SEQ ID NO: 3722 - DNA, 513 bp, Homo sapiens
tccggaacacaagtttatttggcatttggatgaaatgattctcacagcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctagaggaggaggacccctggagcacaaggttcagcaagggtgaccccgggacttgctggtcagactggggacttgcagcaggccttgcaaagggggcattctggatggtggtgcaagaacagatgagcgagtccagctctcctcatgctcccaagggcctcctggagccacagtggcagcggtgttccaggcagccctgccatgtggaccttctgcctggcccaacgtgccagtggcctgagtgcttgtggaggcccatggggaaggggccacccagcaaccccggccagcccaaggccaccctctgc

SEQ ID NO: 3723 - DNA, 575 bp, Homo sapiens
ttttctctggactagcaattgctgtgctggtacatggttcttcctcagaaagtggttcttccttaatgtgtttctttttaccccttatcttcttcttcttcacagatgtttcttcttcttctgccactttttcttcttcctcttcttcaactttaactttaatcttggcttttttggctttcttttcagtaatttcatcctctttatctacctgttctattttgcgttttttagaacaggttggaagtgtggagtcaccagaaggatcgtaagtcttcacttcaataagcacacaatgttgtttcattttagtggctttggggtagtttatgaagactaatagtttccaaaagttaaaggtattaatatttttcaagtaggtcaatcacattcaagagatgtggtgagctaaatgaattctgatttagtaatcaatgtagttactatggtacaggaaaacactcaatcagcatgggggaaatgaaaggagaaaacgtcttcacacctaactagaaagtgaaaactgaaccatccaactttcagaacactgctcaatgggggaaaaaaaaaaaaaa

SEQ ID NO: 3724 - DNA, 412 bp, Homo sapiens
aattccctgaacaatcattgtgtctactttatcagcgctaaacttcaatctatatcgagacaggctgggaagaaaggggaaaataaacttagcaagatagcatctaggaaaagcatttaaattaacaccttaaagtcttttcttgtttttgtttttactcaaatcagcctgtagtcagagctgtaattggtttttctcagaagaaaaatcagctaagtagaaatgcaccatacgagaacagaaaatacacattaaaaaaaaaaactatatgtgctgctacgacctttatttctgtaacatgaatgagtctatgtatgaatgacaaataggataagctgtgtaatacaaaagtcatattggactgggcgtggtggtcacgcttgtaatcctagcactttgggaggcaggtcga

SEQ ID NO: 3725 - DNA, 376 bp, Homo sapiens
agtcgcacataatctttagcaacattgtccactaaatttttggcaatatttatttgccccagagccaacttgtaatgatccttgtcgtagagaatattcatcaaatcagcatagaacggatgaatatcatccaatttggggaaatctgttagaatttgtgaaagtctatcatggtaattctgttgagtaaatttgacttttctcatgtaaaaatgtctaatgcgatgtatttggtaatgtttatgaataacggttggagtctttcgttgagtcttcgacaacgtgaggtctatgaagtcccaggattcctgagaggggaggggggtacgccaaacccagaatccgaaggctcatcacggaccacggaacgcttcct

SEQ ID NO: 3726 - DNA, 617 bp, Homo sapiens
  misc_feature (1)...(617): n = A,T,C or G
ggcagttttataataaaagtgggatggcatgtacntttaagactcacaaaatccacagttctaaagaagtgagtataagttgtgttaaaaaaaaaattcaaactaacctttaactttaatcttggcttttttggctttcttttcagtaatttcatcctctttatctacctgttctattttgcgttttttagaacaggttggaagtgtggagtcaccagaaggatcgtaagtcttcacttcactgaagaaagacccaaaaagttttagaaaatctctaacaagtatctggaattgaaataattctcaagagataaagaaaatgccattagataatacttacataagcacacaatgttgtttcattttagtggctttggggtagtttatgaagactaatagtttccaaaagttaaaggtattaatatttttcaagtaggtcaatcacattcaagagatggggtgagctaaatgaattctgatttagtaaccaatgtagttactatggtccaggaaaccacccaatcagcatgggggaaatgaaaggagaaaacgtcttcacccctaactagaaagtgaaaactgaaccatccaactttcagacccctgctcaatggggg

SEQ ID NO: 3727 - DNA, 600 bp, Homo sapiens
  misc_feature (1)...(600): n = A,T,C or G
aaaatacaaagaaaattttatttgtatatcaaagactctaagaaatgatgacataaggttaacagagttgatgtcaagacaaataggtttgaagttatagatgataaatcactttgtcttactgaaccttcccttgattacgttagagagcatccctggtatgctcccagttgaatcttaagcatgatgtgtgtccgggtgatataatcgtaattcctttctgttaatcctcgttctctctcttttttttctttttcttctttttctctggactagcaattgctgtgctggtacatggttcttcctcagaaagtggttcttccttaatgtgtttctttttaccccttttcctcactgccccctacgtgtctgaccggcccctaatgttcctctgggtccccaaaggaagcgtcccagtcccacacatctcgtgccagccaccctggtcccgcacacacagttctgaggcctggcaggaatcctctgagctctcaggctcangcccgtgggggactctgctgcgtgggtcctcgggccctcantggcaactggaacccataatgcacagnctgctggtctggaanctggctgcctgcccca

SEQ ID NO: 3728 - DNA, 574 bp, Homo sapiens
  misc_feature (1)...(574): n = A,T,C or G
gcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctagaggaggaggacccctggagcacaaggttcagcaagggtgaccccgggacttgctggtcagactggggactgcagcaggccttgcaaagggggcattctggatggtggtgcaagaacagatgagcgagtccagctctcctcatgctcccaagggcctcctggagccacagtggcagcggtgttccaggcagcctgcatgtggaccttctgcctggcccaacgtgccagtggctggagtgcttgtggaggcccatgggaaggggccaccagcaaccccggccagcccaaggccaccctctgcagcctgcatggtccanttacccgtttcctcaatgcccctacgtgttgaccggccctaatgttctttgtcccaaggaangtccatccaaaatttgtgcagcaactgtccgaaa

SEQ ID NO: 3729 - DNA, 381 bp, Homo sapiens
tttttttttttttttttttttttttttttttttttttttttttttttttttttttttttttttttttttttttttttttttttttttttttttaatttatataatttaagagcgtattttaagcacgggattccgacacactcataaacgggttggctcccagctcttacaaaagaaaataaggtttttctccatcaaaaacaacccagttacaccagtaaatcttcccagttctgaaaatctgaagcaactgatactccattaaatggggaaacactgtctactcaaaatatttgtaatattatgcagggacaaaaatttcccacacctatatagggttaaccatagttttcagcaaagcaacaagggctttacttattt

SEQ ID NO: 3730 - DNA, 471 bp, Homo sapiens
  misc_feature (1)...(471): n = A,T,C or G
aaagggccccagccatctcccacccaaattcctccgggtgggggggaaanaggtgccaggaaggccacagtccaggnatggnagggnatgccaggaanaatgnaagggccccaaccaccagccagaacccatcccagggcctggcggagaacacagggtgggggggaaggtggtgcaggaggcacagtcaggatggaggggtgcaggagaatgaagaggcccagcatctccaccagagtctcggggtggggaaggtggtgtagggggcagagtcaggatggagggatgcaggagaatgaagcggacaggcccagctgagccgaagccatgctgctatcttccagcaatactactataataaaaaggaaaacaatccgcaatttaaaaagtgacacaaaccttcatgatggctggatcaatataatcagctatattatggccttcccagatttctggtatcttatcatgttt

SEQ ID NO: 3731 - DNA, 482 bp, Homo sapiens
tttccggaacacaagtttatttggcatttggatgaaatgattctcacagcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctagaggaggaggacccctggagcacaaggttcagcaagggtgaccccgggacttgctggtcagactggggactgcagcaggccttgcaaagggggcattctggaagagtgggcccccagtgacccgtgaagttccatgtgccaccctcacctgcagacgcttggccacatacacacacagagacacaaacatacaaaggaaagatccagacattcaacgtagaaaagatattgatgtgctaaaaatcgcacagaacccgcttaatctccaaacct

SEQ ID NO: 3732 - DNA, 439 bp, Homo sapiens
gctgccagagatagtattttcagtgtgccaaccacagggagattctaggggggaaaaaaatactaacacaatggaagaaactggctttaatccaaccaataacagtttcttctaaccttatccttcagtgtacacaaagcactttttatttaaataactcaccattccctatttaacaagaaagagacaatagaagatttaatgtgtactacagagtagaagaaaaatgggttgtaaaaaatgaaaaagtctaacctcaaaaacaaagcaaaaccctataacacacctttcctttgtgtttgggacttgtctggcccacgagtgaagcatgataaatgagaccatacttaggggtataccgtctagatttgagggctctgaaaagtgccttttcagctccaagaatctgaacggtagaagctgcatgcttgggcaattt

SEQ ID NO: 3733 - DNA, 460 bp, Homo sapiens
  misc_feature (1)...(460): n = A,T,C or G
aacaccatctcccacccaaatcctcggggtggggggaaanaggtgcaggangccacaatncaggnatggagggnatgccaggaanaatgnaagggccccagcacagcaagaancccatccccaggggcctggcggaagacacagggtgggggggaaggtggtgcaggaggccacagtcaggatggaggggtgcaggagaatgaagaggcccagcatctccaccagagtctcggggtggggaaggtggtgtagggggcagagtcaggatggagggatgcaggagaatgaagcggacaggcccagctgagccgaagccatgctgctatcttccagcaatactactataataaaaaggaaaacaatccgcaatttaaaaagtgacacaaaccttcatgatggctggatcaatataatcagctatattatggccttcccagatttctggtatcttatcatgttt

SEQ ID NO: 3734 - DNA, 543 bp, Homo sapiens
  misc_feature (1)...(543): n = A,T,C or G
tctacagtgatttcttaaaactgtattcaaatctaggtctagtgagtttttattatgaaaatgttaactgttttatcctcctgcattcatccgattgttctaattaaccctaacaaacttctaacaatggaccacaagtgtctcagaagaggtagtgactaaagatgccttcattatccaaaaggaaatcaggcaaacaaatagaaatcatcattgaacacttggcccttagtgatctcccacatatcatctacttttgtgttatcagctaaaatttctttaacagctgtagtttaaagatgtaaacaaaatcctaaccagaaaatacttcaaacactcatatttacaaattacattaaaaccatcacctgcatgagcaataagccgtgctccaactaattccccaaccatgactgtaacattgngtgcaatggccatcattcgattttgtagatattcatagagctgggttcgatattcagagatttcaatcacctagtataaggaataaagttaagtcacaaatatcatatgagtaaaaac

SEQ ID NO: 3735 - DNA, 328 bp, Homo sapiens
  misc_feature (1)...(328): n = A,T,C or G
caccaggttggggggaaggttgttgccggagggccacattccggnatggaagggttgcagaagaatgaagaggccccagcttctccacccagaagtctcggggtggggaaggtggtgtagggggcagagtcaggatggagggatgcaggagaatgaagcggacaggcccagctgagccgaagccatgctgctatcttccagcaatactactataataaaaaggaaaacaatccgcaatttaaaaagtgacacaaaccttcatgatggctggatcaatataatcagctatattatggccttcccagatttctggtatcttatcatgttt

SEQ ID NO: 3736 - DNA, 287 bp, Homo sapiens
  misc_feature (1)...(287): n = A,T,C or G
catcaaagtctctgagacatctctgtgaaaaaacgctgncatttgctntgcncgatgctccataaactctcctgagtcctcaccactgaggaagcaaagggacgcccagcctccagccccaaatagggaggctnacttgggacgtcctatcaagagtctcacctgggtccagacacatgaacttgcagcactctttggggtccttgcggtactgttggcagccctggggcctctcacagagagcagccacacacatctcaggctcccctccatggcagctcgtgccg

SEQ ID NO: 3737 - DNA, 241 bp, Homo sapiens
  misc_feature (1)...(241): n = A,T,C or G
ctggactagcaattgctgtgctggtacatggttcttccttagaaagtggttcttccttaatgtgtttctttttaccccttttacttcttacttgcttacanagatgtttacttcttcttctgccactttttcttcttcatgatggctggatcaatataatcagctatattatggccttacccagatttgctggtatgcttatcatgtttttcagacaaattncattaaatncccancantg

SEQ ID NO: 3738 - DNA, 488 bp, Homo sapiens
caaagaacaaagaagtttatttctttcctatgcaacaactccaaggtcaacatttcaggccatgggtagctgtgatccaggaggtcatttgggaagccaggctgatagcagttctaccatcttccagatgagatctccaaggtcactctagtcttcacagttccgcaagggtccgcggcttcattcttgaagtcagtgagaccaagaacccaccaattccggacacacactttttgagatgtcttggcagagtagtcttccagattctctggattcagtcctgttccaccacttgctagatctgtgtcattagaccaatcaattgacctctctgtgcctccgtttttgttctgtgcttctcttctgacttggccaccaggaagttccatgttgaactaggtcttattcacagttaagtattccttcccatttgaaggcatattctcttcatcttttcatagctttttaatgcacggttgcttgtcgac

SEQ ID NO: 3739 - DNA, 359 bp, Homo sapiens
tttttttcaaagaacaaagaagtttatttctttcctatgcaacaactccaaggtcaacatttcaggccatgggtagctgtgatccaggaggtcatttgggaagccaggctgatagcagttctaccatcttccagatgagatctccaaggtcactctagtcttcacagttccgcaagggtccgcggcttcattcttgaagtcagtgagaccaagaacccaccaattccggacacacacctggattcagtcctggttccaccacttgctagatctgtgtcattagaccaatcaattgacctctctgtgcctccgtttttgttccatcagagctgacacagctccagtccacgggcttctcc

SEQ ID NO: 3740 - DNA, 314 bp, Homo sapiens
tcaaagaacaaagaagtttatttctttcctatgcaacaactccaaggtcaacatttcaggccatgggtagctgtgatccaggaggtcatttgggaagccaggctgatagcagttctaccatcttccagatgagatctccaaggtcactctagtcttcacagttccctgtgagaggtgacagcgtgctggcagtcctcacagccgtcgctcgctctgggcgcctcctctgcctgggctcccactttggcggcacttgaggagcccttcagcccaccgctgcactatgggagcccctttctgggctggccaaggcc

SEQ ID NO: 3741 - DNA, 2272 bp, Homo sapiens
actatcaatgacgagttacattttattagtttataaatttgtatcattttcatgtgtaccattgatgacatcaattaaattttagttatttgaaaataggttatactacaagattataaatgctagataaaagcagttaactctatagtaaacctagctaatttgcaatattgagattaagtacatgagacttgtaaatatacaaatgtgcatgtacatacagctataacttctgtaataatttaaaacaatttatttcaaagggaacaattaaggggagactcctctattttttccgtatctgatctttgtaataatgtttgattaagactgtaacagcacaaaaatatttcagtaatattctctttgaaatactgtttgaaagccacatggccaatggtttactttttgtttctctttagaatgaaatggtgtaaccctataaagccacaaaatagtaaagttcatttttagcaaatactatataaacaaagggaaaagaccctccccaccttctgttgctattttgagagtcatagttgctttgaactgtgtttttttttttttttttgggttgagatgctgtttatttatcaaggtttacatgtacaaaataataataaatcatagtaatgaattgcatcttttagtaataaacttgtttataacagtagttttctctcttttcagaatttaggacctttagaaaagttactctctggaaaataatattttatttaaactctggcattaaaaaaactactctttggaaatttaggcatgacttttaatgtatacattctgtttttcttattatttctaattctcaaaatagtaacatatattctgatcccacatcttaaaaatcctgaagagaaataatgaaaccatttaagttaacatgtacaccattttcttcatatactgcagaccaagtattaaatgttccatgtgggccagtcacactgtgctaagcactttatatgatttacttatataaatcttcataataattctattaagtaggggtaatttttactcctattaattggtgaataaactaagattttaaaatattgcccaaaattacctagatttgtgtcagaactcgtgtttgaacctaagccatttgactgcagttcctcacctcaatcataagctgttgtagttcttattccaaatggtgacaaaaaatgtctgtcatcaaaatgaattcattcagaatgagttaaagaggtattgaggtaattctgttccatttttaccaatatctgtggttgtgctttaaaggtacagtggtgagtatcaagtttggaacattttaggcccctctaaaactcatcattcctagtgccatttattgagaatgtctctggtcatgctgtggcaaaaacagccacaagtttaaccctcttccatggtatggatggaacttgtcactgaactgtctttgtactgcaccagtggccttggcatgactctgggctgctaatcctagtgagggcctgaaaggagtgctgggactcactagctgaatctattgactgtgcgcttcatagtttccttttgcttcaccacacaacaaacacggttttcatacactatggaagacagtttcctgtagattcccatctgctctctacctgaaaccctagatttatgcatgtttgttcaattaaggagaatggggggagtctctacattgacctctaaaatctcttgaaatgtcatctcctaatgccataaatttcattacacaagagaaggcagagatatttttataataataattgcattttccagttgtatgacattttgataacactccaggtaagataattagggactataaaagaagaaacgtttttaaaactttctcggaaatgtactgacctagtgaaatgtctttaggagaatttgtgagtaaaatttgtgagtaaaatgaaaaattgtatggtatattttgcttttatgctatcccaagtggaagttcacaatcctgatgtattccaaatcatatttacatatatatgtgtacagatatatatatatgtacatgcatatgtaatacctaccattaatttattctcatcctcagaattgctgtttttttattctttctgtctctctcttcctcttcctgtctttttctttctttctttcttcttttctttttctttctttctttctttctttctttctttctttctttctttctttctttctctctctccctccctctttctttctctcttctttccctaagcccttc

SEQ ID NO: 3742 - DNA, 3606 bp, Homo sapiens
  misc_feature (1)...(3606): n = A,T,C or G
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaagaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgacttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatctatgtataaatattttggtgtgctacaaaagcctttacaaattatcagtagtagtttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatctttacccaaaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaattttttnnanc

SEQ ID NO: 3743 - DNA, 636 bp, Homo sapiens
aaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagaggtaactgactgcttttttcatttcagcatcctaatgccatgagttaaatggaaaattcagtagttagagaaatggatttgtaatacgtaaggacacatggcatttagagtgagtaatggatggaggaaagtactttagac

SEQ ID NO: 3744 - DNA, 470 bp, Homo sapiens
tccagagaaagcgagaattgaggtagggttaggatgggcttggggaggtctagccagtatggaactttcctggacattcgcgaagttcatctcctgggtcacaggatgtacaactacccattttacattcttatcactctcactcactcattttctgatacttgttgagaatctttatcccatgcctgacaaagggagattgtgctgtgttaaggaatgcaatcaatgaagcttttatcacagtagtatgtccagggttagttacctgacacaagcttttagggaatgtaattgtcacaggacctgaggcgatatttttaatgattgttcagtttgttttttttttattttctgctctgagtaaagttttctctcatgtattgagatgctttttttctcttcacaatatagcaaatggaaaggggacaatagcagtgtcagttccctatgtatcagcccagatggaaaga

SEQ ID NO: 3745 - DNA, 488 bp, Homo sapiens
ttacttcagtaatgaagtaaatttactgatacccaaagactgtgcttgtctgttaagcacaagacgtaatataacatactccattcagtccctccaacccttatttttgctaaattcagtttgtagtttattgccttggtcttaaatgatttaagggattcatttttacagacttttttttttctgtgatgtccttggtttgtcagtatgctcatcttaataatccttttattttctcacagaaagtacttcaaactaggaatgtaaaccttataaagaagactgtattaaggatgcccctgcatactattattccgttgttacaagaggtaactgactgcttttttcatttcagcatcctaatgccatgagttaaatggaaaattcagtagttagagaaatggatttgtaatacgtaaggacacatggcatttagagtgagtaatggatggaggaaagtactttagacaaaaaaaaaaaaaaaaagt

SEQ ID NO: 3746 - DNA, 770 bp, Homo sapiens
  misc_feature (1)...(770): n = A,T,C or G
tatagttaggattaattacttaatagagaaatcctaactatatcacacaaagggatacaactataaatgtaataaaatttatgtctagaagttaaaaaaaaaaaaaaaacctcgtgccgaattcggcacgagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagattttttttttaaactaccatggtcccaggattccatcctgaaatttatttttctttgtatgaatatgtgtaaatgatttaaaaataaaactgtaaaatatttgtacgaagaataaatggaactgatgtgggtaaaaaaaaaaaaaaaaaaaaaattgggcgaagttatnccctagtgaggtattngctgnactgcgcgttaaagcggctggaacctgggtccacttacgcttgagaanccttgcatgggatgg

SEQ ID NO: 3747 - DNA, 494 bp, Homo sapiens
  misc_feature (1)...(494): n = A,T,C or G
gggnaagggggtaaggtaaatgcgggcaaacccctccancccccttaaaagcnccctgtgaagggggaaattgagcccaactgttatanaaaangggttcagaaaaagtgcaancttgcccagaattctagcaaatgggttcagtgntacccanaagcctttgctgtaccntcttgaaatgtttcctaggggagagcatnggaaaanccccttcccccatctagancgaaggaagatgagggagcagcttggantcctctcagttgccccctgcatggggagatacactaacccccagaaatgactgctaagcctcttgccntgtctttagtagcnaatgagcagagagattttttttttaaactaccatggtccccnggatncccgcctngnanttaactgtcttnnnnncntgttntgtgtntncntttcgaannaacctgtactgtatttgtagctannanaattgnaactnttatttttnaaaaaaaaaa

SEQ ID NO: 3748 - DNA, 329 bp, Homo sapiens
  misc_feature (1)...(329): n = A,T,C or G
gattcttctcagttgtcccctgcatggggagatacactaacccccagaaatgactgctaagcctcttgccttgtctttagtagctaatgatcagagagattttctttttaaactaccatggtcccaggattccatcctgaaatttatttttctttgtatgaatatgtgtaaatgatttaaaaataaaactgtaaaatatttgtacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaagaaacnacnnagc

SEQ ID NO: 3749 - DNA, 3759 bp, Homo sapiens
ggcacgagcggcacgatccaccgacgacctcactcagctgcgttacgcgccgctccggctgccggccgcgcgccttgcccgccggctcccgcccgcaatcggcggctcagggcggacccgggtctctgcgttctcgcgagaagcgcggcgctgcggggccgtgggcgcctgagcccgcgcggccctcgagggccgaatatggggggatgcacggtgaagcctcagctgctgctcctggcgctcgtcctccacccctggaatccctgtctgggtgcggactcggagaagccctcgagcatccccacagataaattattagtcataactgtagcaacaaaagaaagtgatggattccatcgatttatgcagtcagccaaatatttcaattatactgtgaaggtccttggtcaaggagaagaatggagaggtggtgatggaattaatagtattggagggggccagaaagtgagattaatgaaagaagtcatggaacactatgctgatcaagatgatctggttgtcatgtttactgaatgctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggatttattggctatgctccatatgtcaaccgtatagttcaacaatggaatctccaggataatgatgatgatcagctcttttacactaaagtttacattgatccactgaaaagggaagctattaacatcacattggatcacaaatgcaaaattttccagaccttaaatggagctgtagatgaagttgttttaaaatttgaaaatggcaaagccagagctaagaatacattttatgaaacattaccagtggcaattaatggaaatggacccaccaagattctcctgaattattttggaaactatgtacccaattcatggacacaggataatggctgcactctttgtgaattcgatacagtcgacttgtctgcagtagatgtccatccaaacgtatcaataggtgtttttattgagcaaccaaccccttttctacctcggtttctggacatattgttgacactggattacccaaaagaagcacttaaactttttattcataacaaagaagtttatcatgaaaaggacatcaaggtattttttgataaagctaagcatgaaatcaaaactataaaaatagtaggaccagaagaaaatctaagtcaagcggaagccagaaacatgggaatggacttttgccgtcaggatgaaaagtgtgattattactttagtgtggatgcagatgttgttttgacaaatccaaggactttaaaaattttgattgaacaaaacaggaaagatcattgctcctcttgtaactcgtcatggaaagctgtggtccaatttctggggagcattgagtcctgatggatactatgcacgatctgaagattatgtggatattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgggtgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatccgggagttcattgcaccagttacactgaaggtctttgcaggctattatacgaagggatttgcactactgaattttgtagtaaaatactcccctgaacgacagcgttctcttcgtcctcatcatgatgcttctacatttaccataaacattgcacttaataacgtgggagaagactttcagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctccttattctttttttggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttagaaaaaaaaaaaaaaaaaaaaaaaaaaaaaaaaaaaaaaaaaaaaaaaaaaaaaaaaaaaaaaaaaaaaaaac

SEQ ID NO: 3750 - DNA, 2295 bp, Homo sapiens
attttgttcgtgataaactggatcctgatatggctctttgccgaaatgctagagaaatggtaagatatgcggtgatggcttgcttgaatgttcttataagatggcttgctttaccagttggtgtgtcactgtgttttgatgccctttgtcttgctaatttgtaagtactagccaatttttttggttctgtgttaaaaaatttgggagtaattttggagataatttaacatttacttatagaaatggtatgaaaaatgttagtttttgtgctcgggctaattcataggcaaccgagttggatttcagtaataaagatgtatttgttacaaatcagctttgctcttttaagaatacatctttaatttgaaattctatagtgaaaacttgacctaattaaaattaattagataagcttcgatgaaacaatatttccagatttaagaatatttttgttctaaaattaatgtccacattttctctaactaggtaaaattttaaaattattattaacttcacattcttagaaagcaggattattaccaccaaactagtagaagtgttgagatacatagtgtatttactctaaataaaatactaatgataccttgctgcactacaaatgtacttttattataaaacttaaaatgactagaaaataatttttcaaaatgcataaacatggcttagaatatattgatatgatttttggttttagaaatgatggggctattttatttccgatttccaaatttatataagcaattgtgatttgatgaaaagtcagaaaagttggcaagtatttttttcttagtttaacaaagcatgtattgtttgaatatgtttgttttctctacaaacctgtgtgcattattattgaatatcctcagtacttgtgatagtattttgtgctcatgtttggctaatttgactcaacagcgcatcatggaatggcctctcttactcattttttccgttgtcttatgtgtctaatgaaagttctgctaaggaatgagcttagacttatgtttgaccccaccacacctcccaaaaagaaaagaaaagaagggctgaaagagctggagatgtttctttgtgtgtgctataagctttgcttgttctgcatgttgtctatgaaggacatttcagaatgttagcttttgatcaacagctgctattatttttatttaccaaagaatacctgagagagcgggtgtacaggtcaacttacccaatgcttctcttcattttagactttacaaagggaaaaagactcccctactccggaaacattccaaatgctcagccccccaaaggtgttatttttacttattttatttatttttgtttatttaatatttgatatagtatattgcctagtagtaaagtttctttaagggccttatttgcatttagcttggtaaaatgttgattttcatcagtcatctgtgtgtttgcgtgttttgtgtgacttgggcatgggtcttgtgtgatagtcaactcttggttctttgagctgatttatattttatggctgacaggtgagaaagttaaacctaagtccctttcattctttttttaggtttttatttctttttaaagggagagaagagggtagaagtaggtataaaatagaatttgattacagtaaggtttaggtgcaccttattgagttattaatcactaactcttttactattaaaacaggtccaaaaagaaacacattacctagtggtgtttgccacatttgtctggtttggggcaagaatatgagactggttttctttatctgcctttataatgtatgactcatttgcgtgttagcctttaaacattagaaaaagaaaggaatgaaacagactggtgaaatataactggcagtgaattcttgattaaaaatgtgatgctttctttgaaagagaaagaagccaaaagaggtataattcattgcactgtgtctcaaaaatatttctgctttcaaacaggaattttttccccgatgtctacatctaggatcaatgagaaagggacaaaaacagtccattcttctttttttcagttgagtgtcagtgctatctactagttttgtgtggtgtctgaattcataatcaaaatttgagttttttattttaaactatgcactttttatatgaatactaaaaatgcatgttcataaatgaaatataaagatagaaattaatatcttctatatatttttcctatgattaaatttacttttgtacctacctctaagattaatactgttattttctggcatatagggtgtatttatgtaca

SEQ ID NO: 3751 - DNA, 591 bp, Homo sapiens
  misc_feature (1)...(591): n = A,T,C or G
aaagccggtatagttagaanccttnnnccttctaggatacaaggcaagcagcaaaggcctagcaacaggttttttgtgtgtttgctngttcccttttagaagttctagaaatagaaaacgaanaaattcatgagatagtaggcattaattattttttaaaaagctttttaagtacttgcaattttatatcaggaaaacaaagttgttgagaccttgcttcttccggttttgccctttggtctcgctccttattctttttttggggggagggttatttgcttttttatcttccgggcataatttccattttattcttctgagtgtcttatgttaacttcccctctatcccgcttataaaaaaattctccaacaaaaatgcttgttgacttgatgttttatcacttctctaagtaaggttgaaatatccttattgtagctactgtttttaatgtaaaggttaaacttgaaaagaaatttttgatcgcggtgtcgggtgtcattttctttctaacatgtgtcaccagttgtgattcgctgggggcgatttattgggtggagaaaagtgggtgctaagagctgtcgcggccgccc

SEQ ID NO: 3752 - DNA, 466 bp, Homo sapiens
gtagagaaaaacgcacaagaaagacaacgatctgatagtcagcatcgagatgcatccacgtataacagagacgaagagcttaataacgtggaagaagctttcagggaggagggtgcaaattactaaggaacaattgctatattgagtcaccacaaaaagactggagcttcatgcatcctgggagactcacacatttgcatgaaggacttcctgttaaaaatggaacaagatacattgcagtgtcatttatagatccataagttatttacttttcattgaattgaaatttattttgggtgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattg

SEQ ID NO: 3753 - DNA, 478 bp, Homo sapiens
tttgttgttgtttttgctttgtttccttttttagaaagttctagaaaataggaaaatgaaaaatttcattgagatgagtagtgcatttaattattttttaaacacttctttaagtacttgaattttatatcaggaaaacaaagttgttgagccttgcttcttccgttttgccctttgtctcgctccttatctttttttgcggggacgttattctttttttggggggagggctatttgcttttttatcttcctggcataatttccattttattcttctgagtgtctatgttaacttccctctatcccgcttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttaga

SEQ ID NO: 3754 - DNA, 563 bp, Homo sapiens
  misc_feature (1)...(563): n = A,T,C or G
atattgttcaagggaatagagtaggagtatggaatgtcccatatatggctaatgtgtacttaattaaaggaaagacactccgatcagagatgaatgaaaggaactattttgttcgtgataaactggatcctgatatggctctttgccgaaatgctagagaaatgactttacaaagggaaaaagactcccctactccggaaacattccaaatgctcagccccccaaaggtcgtatttatgtacatttctaatagacatgaatttggaaggctattatccactgctaattacaatacttcccattataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatgttctggtggaaaacatcatgatagccgtatatcctgntnttntttntatgtcccaactgaggatntccac

SEQ ID NO: 3755 - DNA, 952 bp, Homo sapiens
  misc_feature (1)...(952): n = A,T,C or G
agcagccaagcccagggctggcctgaagcccccggacggcagtgcccagcaggcagcgcccagcaccctggctcccacctcccagtggccccaaaggaaaacagctgccatgcacatccccaaaagcctccaggagctggccaacagcgaagccgtgcagtttctgagaaggcccaagaccatcacgcgggtcttcgaaggggtcttctccctgatcgtcatctcctccctgctgaccgacggctaccagaacaagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggacttcatcctggctgttctctgggcagttgtctggttcatgggtttctgcttcctggccaaccaatggcagcattcgccgcccaaagagttcctcctggggagcagcagtgcccaggcagccatcgccttcaccttcttctccatccttgtctggatattccaggcctacctggcattccaggacctccgaaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgaccgctccaaagtccccccggcttgctatgatgcctgacaactaaatatccttatccaaatcaataaagagagaatcctccctccagaagggtttctaaaaacaaaaaaaaaaaaaaaaaaaaaaaaaaaaaaaaaaaaaaaaaaaaaaaaaaaaaaaaaaaaaaaaaaaaaaaggnnggncg

SEQ ID NO: 3756 - DNA, 473 bp, Homo sapiens
agtgatccacttgcctcagcttcccaaagtgctgggattacaggcgttacgacactcgcctagcctaaaatcctgtgttaatgaatagaaatttaaaccgctgcatgaggccggcggtcctgtattagacagcgcaactctactccagcagctcactttagggaaggctaggagggactggggaatgacttgtgggagatgtgtcaacatagaagctaataaaaaaagtatttttcaatacctcgtggaagttcgtgcagaaagaccaccagccccatccttcccatgcctcagcagccctgcctgagtgagctttccccctgccccttttctctccctgtgacgccacagttctctgggcagttgtctggttcatgggtttctgcttcctggccaaccaatggcagcattcgccgcccaaagagttcctcctggggagcagcagtgcccaggcagccatcgccttcaccttc

SEQ ID NO: 3757 - DNA, 376 bp, Homo sapiens
agggcgggccctcaggtgacgcagattggccctccagagaaggggcggccccttctcaggtgccgtcacccccaaacctcagcactgccattccaggtccttaaaggggagaccgcgattctaagaagcagccaagcccagggctggcctgaagcccccggacggcagtgcccagcaggcagcgcccagcaccctggctcccacctcccagtggccccaaaggaaaacagctgccatgcacatccccaaaagcctgagttatgctagctctgccctgtccccctgtctgaccgctccaaagtccccccggcttgctatgatgcctgacaactaaatatccttatccaaatcaataaagagagaatcctccctccaa

SEQ ID NO: 3758 - DNA, 895 bp, Homo sapiens
  misc_feature (1)...(895): n = A,T,C or G
gccaattactcataacaaaaccctctctaaggaaagagaacgtacatataacaaatctggaagatggttctatttggacgattcagaagagaaagttcataatcgtgattcaattaaaaattttcaaaaaagttcagtggtaataaaacaaacaggcatctatgcaggaaaaaagcttttcaagtgtaatgaatgtaagaaaacttttacccagagctcatctcttactgttcatcagagaattcacactggagagaaaccttataaatgtaatgaatgtgggaaggcctttagtgacggctcatcctttgcccgacaccagagatgtcacactggcaagaagccctatgagtgcattgagtgtgggaaagctttcatacagaacacatcccttatccgtcactggagatactatcatactggggagaaaccctttgattgcatcgattgtgggaaagccttcagtgaccacatagggcttaatcaacacaggagaattcatactgggagagaaaccttacaaatgtgatgtatgtcacaaatccttcaggtatggttcctcccttactgtacatcaaaggattcataccggagaaaaaccatatgaatgtgatgtttgcagaaaagccttcagccatcatgcatcactcactcaacatcaaagagtacattctggagaaaagccttttaagtgtaaagagtgcggaaaagcttttaggcagaatatacaccttgccagtcatttaaggattcatactggggagaagccttttgaatgtgcggagtgtggaaaatccttcagcatcagttctcagcttgccactcatcagagaatnccatactggagagagncctatgaatgtaaggtttgtagtaaagcgttcacccagaaggg

SEQ ID NO: 3759 - DNA, 1147 bp, Homo sapiens
  misc_feature (1)...(1147): n = A,T,C or G
canntggcacgcagtacagtnattctagggatcctctagagcggccgcccntttttttttttttttttttttttttttttttttttttttttttttttttttttttttttaattttctgccccagtttattcatcttgggttggtccagaagccgggtttatacactcaatatgcaagagctacagacaaaaagtcttcagggcccacccctcacccccactctctggatctttcacccatccacctgtcagggatgaaactctttagagataggaagagccccccactttgccgatagggagactgagggccagaggctgcatcagtgacttccatgccactgttcacccaccagtgtcccctcttcataccactgctcacccaccaggatcttgcattctcttggctcccaagaacaaagcagagagctaagctaccttagtcgttggttctctccaagactcacccactctgtaactcgcggagcctgccaatccctgtttgaagggccatgcagtgaaagaaggggttaaaattcagcatcctaagcatctccagaggcttaggctgacactgtccccttcacatcccagaaagccaacctctggctcctcctgacagtccgacttcagagaaatgaaccaaaccaattcaacatccaatgctgctaaagccagagaggcacagcaaggtagaggcagagacagggaagcgatattttcctcatcggccttggaacatcttgtctgttacttgcaagcttataaacatacattgcttttcatcagaagcttaaatgaacacggtttgcaacagctccttttccaatggagagatggtttgtttgggaactggtattttagaattcccattctcctattcttcacagggttccactgttatcatctttcctgtccccatctcccatgtgcccaaaggcagagttcaagagggacagtcccctatgtcctctgtccccatccccaccatcatcttcatcactactcctggttccctttcctgataccagttctccacacactgncaaaattggaggcaaaattccatggnaggncagagnagccacttaaacctcctacaagttaangncaacatcaaggganaataggcctcaagttgagaaag

SEQ ID NO: 3760 - DNA, 895 bp, Homo sapiens
  misc_feature (1)...(895): n = A,T,C or G
ttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccnctaaaaaatcnaa

SEQ ID NO: 3761 - DNA, 478 bp, Homo sapiens
agtctggaaagttgggatttgcaaataaaggctctggaagcattgctggtcctgaagctttggaggtgggcagagagagctttcaaggaaggacttggattgccaaacccctggaaagggattaaggcctcaactcttggagaaaccaggccacagcctcttcaggagcagcttgttggctgtaaatagaggtagcaaggccgcttcccaggcccctgtgagtgtgggcacctgtagagccagaggggccaccccagggcagtgacattccagatatgttgggctcacctcatccttgctgtgagactggagttccatggggaccatgaaagtcagtacatccgcagagctgctcagctgctctacctctcgctgacttttttgttgcacatatacattttctttcaattagcatttatttcagcttttatttaagctttttgacagtacatgtaaaatatatgattataaccattta

SEQ ID NO: 3762 - DNA, 191 bp, Homo sapiens
gcagccatgacctgtgacggaaagaatcagaagggggcccagacccagacagaggaggagatgaccagatatgtccaggagctccaaagcatcagtgtctggatcccagcatcttctccacttcagcgctgagttcagtatacacaggtgtctgctacaggcgccaaatcaccagtatttgctataaagca

SEQ ID NO: 3763 - DNA, 486 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggtcctgggcggcccaggagaagcagttcccgccggcgctgctgagtttcttcatctacaatccgcgcttcaggtgtcatttagatggaagaggtcttctcaaaccggctggcctttccctcaggagaagctgaatttccttagatgtattttcttgacacttcagtttacaaagacgcttcacttcatactccctttcgagtttgatagattctgcagaagggagcagtccatctttaatggtggtacattttgtgagctgcacagaaccaccaaatgaaatttcttccaagaaaggcaacttgatattggctaggtt

SEQ ID NO: 3764 - DNA, 2575 bp, Homo sapiens
ttttttttttttttttttttttttttttttttttttttttttttttttttttttttttttttttttttttttttttttttttttttttttttttttttttttagttttaaattatatatatttttttctttttgaaattttttttcaaaattccatagttatatacagtaacatcaatttcaacaacagcagtacaaagcacacatttgacttacaggagcactgattgccaaagaataccaaagtgtttcaccttgatgatccatgggaggaccccacaacactacagacaggtaggagggagaacaatgacattttgccgtgaacttagttgagctcacaggaaaacaaaaacaaaaaacacatcaccaggattttgcattttacattcactaggatgtatgacagatagagttaaaacatcaacaacttaaatataattaaatactttttaagaaatattatgctttaaattatttaaaaataatctctttgtggatgttataataaaattaatgtcacactgcacctggggggaagttggggggaaaaataataaagcttttctttaagctctgatcctcagtccatgtattgaagggctcatggcttcaaattttggaaatttttggtccagatggcttattggaatccctggacccatcttcctttgggggcaacacagacctccttgccccgttgggtcttgaagctgtgggggagagagggcacaattagatggaagactttgaagatcctgcacaggactgtgggccattggtccctaggactgatcagcccttggtccttaggtgaaggacccggacccgggagaggagggaggggaagagtgggaggaagaagctccagaaggaagctctgctcttgctgtccaggtgaaaccctccagggtcctggctacagatattgggttagtttcaccaagcccctagaagggaatcctagagcagttatggactccttctcacggactgagtttctctatggggtagagggcccctttggatagaagttatatgcatccgactcatatggacatgaatcttgacttctctatgttgtccatcagaacttttgaatgggggtgccaggcactgtccactcacatcacagcttccttgggacattggatgttggtgattcttgtgtagctctccagcctctggataggaattttcctattgatcacgttaaagcagcaggtgattggaatggaaactgaatctgaaagaaattttgcaaagaatgagacatttaggacccaccgtaagtgtgcatttgtaaggaaaagaagagaaggaaggagaagaccaagaagtcaccatcccaagttcagtgtcttagtccagatcccagagataaaatgttgcctgtgagtctctttcctctattgaactctgcggcccgtcattgttgactgggtttggaaacattttgagtaacaagctagtccttgtctactaacccaaaacttctgacactgggaacataagttccaataccttgcttcccagtctttcatcctcatgggctttagagttagcctatgccatacgctgagattcctctgggtcctcatcctctttacacagccactgttctggaaggtacactgaaccataaccaaaatttgaagcttcaggcaatagtttctccctctccactacggcctgaaatgtcctttacacccacagtgagaaacagttcttcgttctggattatttccccaaacaatgggagggttgttgctgtagcggctccactgtctcctcccaaaactggggtcaggaaagatcaagggaaccagcctcagtgacctgagcctttagttctggttttgttcctaatgagctgtgacataatggctcttcttaattcctcttttggtctccccttaaaaagggagaggtcttacctggctgagcaagtccctgagggctgaaagtggctgccatgagcagcaggcacagaagcgctgcagaaaccttcatcttggagggcaagggtgtgagcttcagcatgagaggtgaaggtttctgggttgttctcaacctctctgctcctcggtggctctgcctgccttttatagggagcagagagcctgggcatggtcacaatcaaggaagaatgaagtaagaccttccttgaatatgctgagtaagcaccagatcctgggataatttccagataacaaaacaaggaagttgtgagtttctatcttttgcttaggctctgtggagcagaggctgaagggtatgggattgtgctcagcaaagtgacctcactgaactattaagggctctgatttccttgaaatggaaaattgtctataagaaaggaagaatggaagctgacgtcatagtggaagagagccaaggcttacccctctgtgggtaacaggaggccagggatgggccctaaggctttgctggtgctctccatcacactagagtcacttgcagttctaagccaggcaagctcctttagaaccccagccacagaacgttggcagaatgacagaatcctggaactaagtcttaatgccccagaatct

SEQ ID NO: 3765 - DNA, 1624 bp, Homo sapiens
  misc_feature (1)...(1624): n = A,T,C or G
ttttttttagtgtctgtgcaacacagtgcagtatattgtacagaatatttttaaggccatggcagtctataaattaaaactgatattcattaaaagaacttactgttgactacactctgagtgctcaaccacatttggaaaatgcaggtctacataaggtgctgcttaaccaaaagganccaaaaattcacacacaggtgtgaggcaacacataaggcagggtgtaccataggagttttatctactacagtggtctatatgaataataatttacaaatgaaccagtattaaatatgtccctttaatgtaatacggaagtcgctaaactacaaaacatgtccatttgaagtttttagacatctctggtatcataggaaggcaaacaaacaggcatcagttcctcagttctctgtgtgactggattattaaaccacctgtagacattgagcatgattacattagataaagcaggcaggtctagagttgtcacaataatcaagatgtctaatggcaccagtcaaaagagtgccaaagcttacatcagtaagagagaaaaataaaaattttttatttgtttataagtatcttttgtgctgaaaagtcaactttatgactggatataaaaagtcaggagttaagagtgtcatgcagcagcactgatttaatgactggagatagaacaaacagatgtttgaacaaagactgacattcttaacaggttttattatattgggtggaatgctctaaattcatgaacgcttttggaaaatcttcaattctcgaaccccttaaaaaagtatcctgaaccaggaagaaaaaacaagagacagaaataatgatctgggacagatacaaaacaggatgctttagttcctccccatatccccaactggccatctgggtgatagagttcctcagaaaagcaggatatctttaatattcatcaggcagaatctcaccagtgcaaagaaccaacattgatctggtgcctccgctcactctctgcagaccattttggattcctaaagatgtaattatacatttcacatgcatttgtgagataaaataaacattatggtttacatatatcccacatgagtcattcacgcctaaaggttttctaaatactgtgtgtggcacctagaaacttccatgctgtatccaagtcagtgtccagtattaagctactggaccctataatgaaatattatagatagacatttactgaaaaccaatataaaaatctggcccagaaagaccagaatggaaatatgcaattttcttgatttaagatggtcataagtatatggggttttttttctgtttttaaagctctacacatggtttaagacaggtatgtgtaagaagcctttttgtgtgtgctgactttatcatgacaactctagctgattctttatgaaggattagggatattcatcttcagcagtgcacatgagaaataaactctgaaaaaggcaatttctggggtttaggaaggaccgtattctgggaattacttcagaggaacggacaataattctaggattatagccaagaaggactggaagacttcaggagatgcttcagcttcttctagattttgaatgctgaataagccactgaa

SEQ ID NO: 3766 - DNA, 2588 bp, Homo sapiens
  misc_feature (1)...(2588): n = A,T,C or G
ggcacgagggcgatcggcggagctcccacctccgcttacagctcgctgccgccgtcctgccccgcgcccccaggagacctggaccagaccacgatgtggaaacgctggctcgcgctcgcgctcgcgctggtggcggtcgcctgggtccgcgccgaggaagagctaaggagcaaatccaagatctgtgccaatgtgttttgtggagccggccgggaatgtgcagtcacagagaaaggggaacccacctgtctctgcattgagcaatgcaaacctcacaagaggcctgtgtgtggcagtaatggcaagacctacctcaaccactgtgaactgcatcgagatgcctgcctcactggatccaaaatccaggttgattacgatggacactgcaaagagaagaaatccgtaagtccatctgccagcccagttgtttgctatcagtccaaccgtgatgagctccgacgtcgcatcatccagtggctggaagctgagatcattccagatggctggttctctaaaggcagcaactacagtgaaatcctagacaagtattttaagaactttgataatggtgattctcgcctggactccagtgaattcctgaagtttgtggaacagaatgaaactgccatcaatattacaacgtatccagaccaggagaacaacaagttgcttaggggactctgtgttgatgctctcattgaactgtctgatgaaaatgctgattggaaactcagcttccaagagtttctcaagtgcctcaacccatctttcaaccctcctgagaagaagtgtgccctggaggatgaaacgtatgcagatggagctgagaccgaggtggactgtaaccgctgtgtctgtgcctgtggaaattgggtctgtacagccatgacctgtgacggaaagaatcagaagggggcccagacccagacagaggaggagatgaccagatatgtccaggagctccaaaagcatcaggaaacagctgaaaaagaccaagagagtgagcaccaaagaagatctaatgaggaggcacagaccagtgtctggatcccagcatcttctccacttcagcgctgagttcagtatacacaagtgatctcatacaagtcgcaaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatcctgcttagttaacccagtgtccctcagacttggatggagtttctggggagggtacacccaaatgaatgcagatacttgtatactttgaggccccttagcgacctaaccaaattttaaaaatactttttaccaaaggtgctatttctctgtaaaacactttttttttggcaagttgactttattcttcaattattatcattatattattgttttttaatattttattttcttgactaggctgactttatcatgacaactctagctgattctttatgaaggattagggatattcatcttcagcagtgcacatgagaaataaactctgaaaaaggcaatttctggggtttaggaaggaccgtattctgggaattacttccagggggaaccggacaattaattctaggatttattagnccaagaagggactgggaagacttccagggaggatgcttcagctttcttctagattttggaatgctgaataaagccactgaagtgtgatatctatattatccttttcttttgcaagaaatttgaataggcagcaaattttctctatccttgaattagcagacagattcatgtttttcaatttagctgtttctcatccaaggcattaggaagatctctcttgtttccaaggcacatcgaacctgagttagcaggaagggattctccaataagagcagaaatgccaggaaatcctcaacactatggaagatttcttaccggacccttgaacctcaatgatccagatgcaaaatgcagattccccaaaatttttgtaaatacagatgacacttatgaagagctccatttaatcgtttataaggccatgagtgcggctgtgtgctttatgatcgacgcctctgtccacccaacgttggatttttgccgaagactggacagcatcgttggcccccagctcacagtgctgccctctgacatctgtgaacagtttaacatcaacaagaggatgtccgggtctgagaaagaaccccagtttaagtttatctacttcaaccacatgaatctcgccgagaagagcac

SEQ ID NO: 3767 - DNA, 2181 bp, Homo sapiens
cttcttccgaaacttcaccgtggaggtcgttggtgtgggagatacctgctcctttgctcagatggatgttcgccagcatggtcatccccagtggctatctgctgggcagacagaggcctcagtgtaccaagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtgggatgccaggacagccagctccgggagcagcgtgtgggaaggacagctgcagagcctgggtgctgtcagaatatgcatccacagagatgaagcctgcatgccctctatatgcaccaagctccacaagcagcaggcccaggctgaacctgagcggcatgtatggcaccgccgggagagtgatgagagtggagaaagcgcccctgatgaagggggagagggcgcccgggccccccagtctatccctcgctctgcttagctatccctgtgcagcaccccggcctgggagctccttgagaccaccgccctgcatggggggctttccagagggcgctaacggtgggcatcacagatcctgggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtataaacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggccctaggaaccggaggacacacgggactctagcctcatccccaggacccccttggctcagagtgtggtgctagaaactggtccccagcccagccccagtacttgccacctttacacctacccctgcaagttccccagagggcttgcccacgattagaagcttgccaagcaggggagaacctgttgccaattgttgggagtggggaggttgggcctggaccctcaacccctgcaaccttccctagccccctcaatagatgagcaggtcaggctgtggcccttacctgcacccgcagttctcgcccagtgctgcagccggctcacctctctccgcttcttgcacatcactggcctgtgtgtgctgcttgctcctgttctgttcgcttgcttcccgttccgtttcggcttttgctttccgttaaggtgaaaaaccctaacgtccaactcccctcaaagcctaaaatttgaacactaaaaaagaaggtttctaaattgtaggagcaggatgggaaatacttttgctgccccttgcccatctttttaggaatgggcccccccaggaagactgaaggtcttccctgggggccctcatttgctggtttattcgtaaccccccattcaacctggcaaatggggaacagaaccgggctggaagggtgaccttggctgtgtacgtcccccacaaaagagctctggccccgcatctgcgctgtgccctgaagggggatgtaagggcgatgccctcgcccgaggctttgggctgctgcactgcatgctgggactgctcctactctctgtcccacccctcacccagctgtggtccggctttgggagagtggtgaattgcgctgcccgaactcggagcggagtcagggtagggaccgtgtacagcttgataacccttaataaaaagggagtttgaccagaaaaaaaaaaaaaaaaaaaaaaaaaaaaaaaaaaaaaaaaaa

SEQ ID NO: 3768 - DNA, 3332 bp, Homo sapiens
  misc_feature (1)...(3332): n = A,T,C or G
ggcacgagtcgaggtgccgggttgcaggcgctcaggagcttaaggggtttgaggcctgctttctgctcgcgccagcagagcactacctgaggcagcgaggcgcagcgagcctagcctccccgcgccctgggcagtgtggccatggagaatcaggtgttgacgccgcatgtctactgggctcagcgacaccgcgagctaatatctgcgcgtggagatgagtgacagtacagaaccctgccatcagcatcactgaaaacgtgctgcatttcaaagctcaaggacatggtgccaaaggagacaatgtctatgaatttcacctggagttcttagaccttgtgaaaccagaggcctgtttacaaacttgacccagaggcaggtaaacattacagtacagaagaaagtgagtcagtggtgggagagactcacaaagcaggaaaagcgaccacttgtttttggatcctgactttgattcgttggctggatgaatctgatgcggaaatggagctcagagcttaaggaaagaaagagcgcctaaataaactccgactggaaagcgaaggctctcctgaaactcttacaaacttaaggaaaggatacctgtttatgtataatcttgtgcaattcttgggattctcctggatcttttgtcnacctgactgtgcgattctgtatcttggaaaagagtccttttatgacacattccatactgtggctgacatgatgtatntctgccagatgctggcagttgtggaaactatcaatgcagcaattggagtcactacgtcaccggtgctgccttctctgatccagcttcttggaagaaattttattttgtttatcatctttggcaccatggaagaaatgcagaacaaagctgtggttttctttgtgtttttatttgtggagtgcaattgaaattttcaggtactctttctttgtgctgactttgcattgacatggattggaaggtgctcacatggcttcgttacactctgtggattcccttatatccactgggatgtttggcggaagctgtctcagtgattcagtccattccaatattcaatgagaccggacgattcagtttcacattgccatatccagtgaacatcaaagttagattttcctttttttcttcagatttatcttataatgatatttttaggtttatacataaattttcgtcacctttataaacagcgcagacggcgtaattggaccaaaaaagaaaaagatccactaaaaagaaagatttaagatgggcttcttgccagtttgagcctaatctgattcttacagtttttaccttcttgaaaccaatgtaaaagtttttttaatgttaaatgattaaattctcagtgaggctatcttccttttccccagtaacattcctgaatttactgttatcttattgtagtacttgcatgacatggattcctgatatctgatgagaggttcattcttgtgtattcagttaatgacaccaaaaggctcagcccaccccaaccctatctcatgttcagtctgtctaatacatgccagagatttttttttcaaagggtgctttatccctacaatgtactgacagttcttacagttgaggatttggttcttttcagctattgcttggtgaaaaaaaagcaagactaatgtcaactctataggaaggctggttaaaagtgactcagggcagggaatttaattattctggtacctaagggggttacttgtttaatgggatggcattgactttttttgaaaaatccaagtgggattgaggtcatttgataaaaccttttttaaaaagtggggttaaagaaccatacttttacatcctgacatcctttggccctaacaacatcctattattatagtgctcagcagtgtgggcattgaagaggcgcagaatgctttgaaagaaacttaatcagaatcttggaacatcatgatcatgcccattcttaagtaaatcaactattttcaacactgaagaaaaatgaaacattatttagaaaacaatgagattacaagttccaaactcagccaggaatgtggctcacacctgtaatcccagcactttgggacacctaggtggggagcatcgcttgaagcccagggagttccaagacccagcttggggccacgtagtggggacccctatctctacaaaaaataaaaaaattagctgggtgtgatggcacacacctgtatgtcccagctactcaagaagctgagatgggaggatcctgagctcaggaggtcaaggctgcagtgagccgagattgtgccactgcactgcagctggggtgacagtgcaagaccctgtctcaaaccaaaccaaaccacacacacacaaacacacatacacacacacacacacgaggtccaaatggtagcagggatccaaagggaacacagtatgtaggtcaaactggcagtaacagtgtacagcctttgacaaactagaaatattagagtaggccaaacacacctccaaactgtaaggctgtgcacaaacataaaaaatggcagccttccatctcctgcactggctgagtccatttactttgtgtacttgttctagtgagtggtgggactgtacaatttttgaatagacctcaaaaatacttcattctgctgctgttcagttgggctttttaaacctgtctggcagtagggacactggaaaacaggcaaggaacttcgggggtggaacaccccgctggatcccttttaacaagggttttctgggccaggggaaacttcaccaaaaagggaggaacttgaaaattttaggacattacagttgggccatttgttaaaaaacatcagtttcctctcataccattcccaagtaaacccaagtaaaataagtgttggagtaacacttgcataaaagaattttaaggagtgatagctctttctgttcctggccattcccgaacattcctggggggaaaggagactcaatgagttaatactatttcactgaggcccaagatgggaaacttggtttgacctaaaacatctggatttaatatagggctaggctggattttcttaaaaaattcgttgcattgaaggatattttgcatgtctgtaacacctgtcaatacttgtttgtattgatttctgatattcttgcagctgactacgtgtaattgggcagatcagctttgcagtagattatgctgcatcctcgtgggcaaaattctgtattcttagtgattgttacaaacccctttattgctgtctgagaaagtggaaaggttgtgtatttcctatttaaaacatttacaatcaaaaaaaaaaaaaaaaaaaaaaaaaaaaaa

SEQ ID NO: 3769 - DNA, 2525 bp, Homo sapiens
tttaaaataaaatacatttataactggcaatgtttaaaaagagaaacaaactgagttccactgaaattaagagattttctcggtctctgggcgggccgtgggaggcttcctgaggtgggggccgggccaggatggctgcagcgcagcgacggccggggccgggagcgggcctgggcggccaggagaagcagttcccgccggcgctgctgagtttcttcatctacaacccgcgcttcgggccgcgccaaaggacaggaggaaaataagattttattttatcatcccaaatgaggtagaaaagaatgagaagattagaaatgtcggattgtgtgaagctattgtacagtttacaaggacatttagcccatcaaaacctgcaaaatctttacatacacagaagaacagacagttcttcaattgaaccagaagaaaatttcttggatggtcatggttgttcggtgtcctataattgaaaaacagagtaaagatggaaaaccagttattgaatatccaagaggaggagttgttggacaaggtttatagctcggtgctgcggcagtgctacagcatgtacaagctttttaatggtacatttcctgaaagccatggaagacggaggcgtcaagcttctgaaagaaagattagagaaattcttccatcggtatttgcaaacgctacatttgcagtcatgtgacctacttgacatttttggtggaatcagcttcttcccgttggataaaatgacttatttgaaaatccagtcctttattaatacgaatggaggaaagcctgaatatagtcaaatacactgcttttctctataacgatcagctcatctggagtggattagaacaagatgacatgagaattttatacaaataccttaccacctcccttttcccaaggcacatccgaacctgagttagcaggaagggattctccaataagagcagaaatgccaggaaatcttcaacactatggaagatttcttaccggacccttgaacctcaatgatccagatgcaaaatgcagattccccaaaatttttgtaaatacagatgacacttatgaagagctccatttaatccgtttataaggccatgagtgcggctgtgtgctttatgatcgacgcctctatccacccaacgttgggatttttgccgaaggactgggacagcatcgttggggccccagcttcacagtggctgggcctctggacatcttgtggaacagttttaacatcaacaagggggatgttccgggtctgaggaaaggaaccccagtttaagtttatctacttcaaccacatgaatctcgccgagaagagcacagttcacatgaggaaacgccccagcgtgtcgcctcacttccgtgcacccggattttaatgaagattcctcggtgaccatccaacagtgacctttaccccagagtgggtggaagatgagggagatcattgttgaagggccttgagtgattactgggttgttggaaaggaagtctgatccggccgggagcccctatgttaattttgaaatccaaaaaaatgccaaaccctgattgaaagtaaaaggaagaggtccaagaaaccttggtgccaaccgcagttccaacaacatccttccttccttggattgacgggatgaccggcctcacccgagagccatatcctaaaaaacactctgcaaacatttggtcacatgcaaattagtggtcatatcgacggactgcattcaggacacagggtaaagcaatacttgctttgaagaatcacatttcgactcggtctgctcatctgaggtttttagatcttaactatttatgtggaattaattaaaggtagttggctatatcgctcaccatctcattcttttgacatctctgtgaatattttactggaaaataagactaataaattgttaaaagtttttaaaattctggtttggtgttgagtctctctcctgctgcctatttatagattacactggccaccagctccgtgacccaggctggaatgcaatggctcactgcagcctcaacctcctgagctcaagcaatcctcccacctcagcctcccaagaagctagaaccacatgtacacaccaccacggtcggctgatgttttaattttgcagagatgggggggtctcactatgttgcccaggctggtctcgaactcccgtaatccagccatgtaggaaacctgagatgcagtgggccaaggggtatgttaaaacactgtgacgagttcagtgctaagaactgtaatgctcaggaaatcttacagcacgtgccatcctaagcctgtgtgtgtgtcctcgtgtctccctactttttcttcttcttgctggtgatggtcttgctggatggggacacggtcacatcctccttgggagggtccagtatgaggtgagaggatgacacgtctagccggctcctttagcaacttgtgatgtccacctcataagtcatgtctcttgggcctcttcctctctcaagatgaagatgttcagccttgcttccag

SEQ ID NO: 3770 - DNA, 2191 bp, Homo sapiens
  misc_feature (1)...(2191): n = A,T,C or G
tggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccagggggaagaagcatcttcataaaaaactttcaagatccaaacattaatttgttccttatttattctgaagaagttgagggcaaatcagtattccccaagggatgggcgacaaggggcagcccaagcagggcttagggatatcccagcctacccaatatggtcattcggactaactagggaggggtgagttgggccctggctcttccttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctggatgaccctacaggtcgtgctatggatatgggagtcctcatggggttaaagccagggaaggagagtgggggaaagaggancccacccccactctgttctttcatatttggcatttcatgtttaacctccggctgggaaaataggaaagcattcccttaggagatgagggttaaaaggaaagttttcaggtttcaacagggggggaaggaaatggagatttaatcctaaaactgtggacttggggggaggtcagtcatttaccagttagtcctgtgtctttccgacttctgtgattatttaaccccactcactaccctgtttcagatgcatttgggaataccaaagattaaatccttggacataagatctcattttgcaggaaagcaggattaaagaccatcagaaaggaaattatttaggattggtaatgacacaggacaactgtgtagaaaactgttgtgaccaaaaatagaattaccttctagtttttgcttgttctcatttgaaatgaggaaaattccaccttttgtttaggcatttcaagctttttatgtatccatcccatctaaaaactctttcaaactccacttgtttcagtctggaaatggcagctccctgttccaagtggccttgggaggaacttcacaggcaggcacggcctttattcaaaggttttaccaggcccttgggacactatggggagggaggggcaaggaggtacaccaatttgtttaaaaggcaagaaaccacagtgtcttctttcactaggtcatttagggaacatgggttattcatccaaggactactctaccctggcaacattggaacttcccagggggcaaatccacattcctcattgagttctgcaaggttctgtgtaaaaaggggaagctgtcgtctatgccgtaggaatccccatgatcttgaggaccattcattggaagctggctaaatagccctagtctgggggagtcttcccataaaagttttggcatgggagccaaacaaacagggtttaaactagggtttgggttcctttcagccctcttaaaaggcatagggctttaggcctgccaggctttccttgggggcttttctctgtggtgtgtagtttttgttaaacactataggcatctgttaaagatcccagtgtcccnctggaaacattcccacatgccgtggactctgggactatatccagtttttgggaaaggcagggggttccctctggcctggctaacaaggcccacgtggggacccagtctggaatggtcttttccttttacacctaatgtttttaaatagtcaaactttcaagaaacaatcttaaacaagtttctgtttgcatatgtggtttgtgaaccttgtatttgtatttagtagggcttctatattgcatttaacttggtttttgtaactcctgattcttccttttccggatactattgatgaataaagaaattaaagtgataaaaaaaaaaaaaaaaaagtcgacg

SEQ ID NO: 3771 - DNA, 582 bp, Homo sapiens
tgcttcaaaactctctctctctctctctgtctgtctcgataaatggccaaagggattggtagtttgcctgtggaggtcctccaggcattgtttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaaaaaaaagatcttaaatttttatgagttgttaaaatagaaattatttgaatatcatatatttgggtaacaaaaggc

SEQ ID NO: 3772 - DNA, 748 bp, Homo sapiens
  misc_feature (1)...(748): n = A,T,C or G
aaggtccaaacaaatgcccancctatatttataatgaacaaattccaagaaaaaggactacggaaagttccaggacatccaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctataaattattgacttattttttatataaggtcactccgatgaaaggtgattacaaaatcatctacattgctgtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaggcattattggagttcatgatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattg

SEQ ID NO: 3773 - DNA, 405 bp, Homo sapiens
tgcctcatatctctctctctctctctgtctgtctcaatgaatggccaaggggattggtggtttacctgtggaggtcctccaagcattgtttggagttgataatacttcagctacaaccaagcagaatctcttttttttggaggtcctcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaaa

SEQ ID NO: 3774 - DNA, 485 bp, Homo sapiens
caaaaccacttttaatgggtacagagttaaatttgaaggaataagttctagctgaggtgttgtgtcctccaagcattatttggagttgataatacttcagctacaaccaagcagaatctcttttttttggaggtcctcgaagcattatttggagttgataatacttcagcttcaatttggagttgataatatttcagctagaacctagtagaatctgtttttttcctttggaggtcctcaaagcattattggagttcaataaactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttc

SEQ ID NO: 3775 - DNA, 1274 bp, Homo sapiens
gaattcggcacgaggatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcctttggagacttagaacctctaaattattgacttattttttatataaggtcactccgatgaaaggtgattacaaaatcatctacattgctgtctacaaaacagataatatggatgtttgatcgcatctcattgttaactctttactgatatgtttgtaaatacagaagtgaaatgtggacataaaatagttacgctatttggttaatggtactagacaacatgtaattaatgacattcaaaaatttatggctagtgatatatataaagtaaaattttctttgcagtaaaatatgccctttattatagaagggaggatataaggaaccaacagtttgtatgaaaatagctcaaataatatcttttattttgattttaatatttcttattttggtttattagtgtcttagaacaaaatggccttatataatgaagcctagttatgctggactgttttgatctcttttaattgttctgacagatagttggggatgagagccgaataaggtttgcctgaaataactgacactatataatttctgctttggcaaatactaagttctaacttgtcattcctggtagaacaagctttatttttcgagcctagcaatgatctagaagcagatgttatctcagtgccttttgcaatttgttgtgtgggttttttttttttttaaagccacacaataattttggaaaacaatgtatgggtagaacatgtgtctgttaattgcacacaaaaccacttttaatgggtacagagttaaatttgaaggaataagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaagaatgcaaaaataaaa

SEQ ID NO: 3776 - DNA, 311 bp, Homo sapiens
  misc_feature (1)...(311): n = A,T,C or G
caccagttggagttgataatacttcagctacaaccaagcagaatctcttttttttggaggtcctcaaagcattattggagttcataatactgaagctagaacccagcagaatctgttttnttctgaggagtatcggtagcataaatgtgattataaacatagtacacttgatatatggaggcagtgacagctatttttcccanatttaaatctgcaaatggattcaccatgtttatgggttattaaaattgtctgatttcttnggttctttatagtacacgtgttgaaaataaatgnttacgaattgtttc

SEQ ID NO: 3777 - DNA, 346 bp, Homo sapiens
tttgctaagctaaatttataatgaacaaattgaagaaaaaaaaggactacagaaagttcaggacatcaaagaagtcaggcaaaactcatcttgacacctcttgcaggcaaaggaaagcagctttggaggtcctcaaagcattatttggagttgataatacttcagctagaaccaagtagaatctgtttttttctatgcgtggggttgctccttcggactgccagagccgggcgtcaacatctgcatcgcttccttctgcagtgctctcaattgtaacctcccttcctcttctttaccctctttcctttcaagtgctgtcttccctctttctgaaagtggtttctgg

SEQ ID NO: 3778 - DNA, 336 bp, Homo sapiens
gtgtctgttaattgcacacaaaaccacttttaatgggtacagagttaaatttgaaggaataagttctggctgaggtattgtggactcaaagcattattggagttcataatactgaagctagaaccaagcagaatctgtttttttctgaggagtatcggtagcataaatgtgattataaacatagtacacttgatatatggaggcagtgacagctatttttacaaaatttaaatctgcaaatggattcaacatgtttatgggttattaaaattgtctgatttcttaggttctttatagtacacgtgttgaaaataaatgattaagaattgtttcaag

SEQ ID NO: 3779 - DNA, 327 bp, Homo sapiens
ggcagtgacagctatttttacaaaatttaaatctgcaaatggattcaacaattttaataacccataaacatgttgaatccatttgcagatttaacatgtttatgggttattaaaattgtctgatttcttaggttctttatagtacacgtgttgaaaataaatgattaagaattgtttcaagaatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaa

SEQ ID NO: 3780 - DNA, 1881 bp, Homo sapiens
  misc_feature (1)...(1881): n = A,T,C or G
gcggcgccctttttttttttttttttttttttttttttttttttttttttttttttttttttttttttttatcaacatttatatgctttattgaaagttgacaagtgcaacagttaaatacagtgacaccttacaattgtgtagagaacatgcacagaaacatatgcatataactactatacaggtgatatgcagaaacccctactgggaaatccatttcattagttagaactgagcatttttcaaagtattcaaccagctcaattgaaagacttcagtgaacaaggatttacttcagcgtattcagcagctagatttcagattacacaaagtgagtaactgtgccaaattcttaaaatttctttaggtgtggtttttgtcatgtagcagtttttatgtagatctatatataaaagtccacacctcctcagacagccaatgaaacaactaaatttcaatctgtacaacctaaatagtagttacagtcctctattgtacaaaatagttacactacatacacaaatatacaataagcaaaacaaccttcatggtaagatagcctaggtcccagctacctgtcaccattttgtcactctcatagttttgtgtcatccattgtttgagaagaaagaggcacagtactattgttttttatgaattttggtgacagttgtcaaatttgtacagtgaactctgttccccctcattttagtctttttaccctcctttcaagttcctcctggggggaggagaggagagaggcgagtccagtgaggagctccatcgcttcacaaccccatgtaggacactaagcgcaagcaggagagagaacccttggaagtgaggggtagggagccggaagggatggaaaggcacacagctcctgagcatgaattaaaccatttctcagatatctgccaagctgcatgaggtcccggtatatccatgctaattctcggattaacctttaattcacccaactaagaaatttctccaagccataagcatatgagtgtttaatactggaaaagagataatggcatatgtcagtctcacgtctctttcgcagcgagcaatgaaatgggtgactgtggaggcagattctccctagcacatcttctccgtctgttcagttcacacgcagcagccagttctgcgggggcataggcagctatgcggttggtcctgagccctgcgatgctggctgggcggggggctgtgtggtgccctgtggctgggtggtggcagggggggagccagtctgcagctgggcctgaaactgggcaagctgctcaggactggccagtgtcttcagcagattgttctcctgctccagctgggaatttttctctattagttctttgatttgctctttgaggacctccacttcttctctgaccgcatacatcaaatggcttttcactagatccatagcttgctcgattttgttgtcaatagctaccacacttgcaccagaggagctattatcaagtctcacagaagcgttttcagtccccagcaaggatgacaagaaagaaattgaaaaatgtctcagttggtaaactcctagatccatcgccactggtctacaccattgggatttcatgcaattgcagccaaaaacaccctcgtggaaaaaaagagggaacaccagcagccttgtataagctagataaaatcttctggctttccgcagcccagggagaaacagaaaacggcagccctaatttaaagaaacccagcttctagggcttgatgatcccaggcagatgcggatcccagtgccgtgaagaggcgcttcccagatccgcagccgggctccactcagctctagacccggggggggggggggattaataaaattaaggatccttgagcnnc

SEQ ID NO: 3781 - DNA, 777 bp, Homo sapiens
ttttttttttttttttttttttttttttttttttttttttttttttacaaaagggtctttatttgtaaaaagccaaaggggcccctggggcaacaggacaggcaggccggcttctcaggggtcaggggcatttgggcagatgcgcttgagtgggggggcaccctccgagtcctctgtgtcaccctgggctgcctcagggacaggtggcactggctcaaagacagggtaagcttcgggggcctcagcttccagcagttctggaacaggctcctccttggtcagcattgggggttcgtcggtgctgccagcagttatgcccccgggatctctctcttggcccagccgtgggggctgagcctcctcagggaccccttctgggggtccggcaggtgacacagggcggctgggctggggggtgcccccaggactgggctctgtgcccttttgcagggaaccttccgaatggaaactctggttgctgttctcatcattaagatccagcaggatgagagggccaccccctcggggactggcgcccctgccccgacgttcccggccacgggatctctctgccccgccacctgcccgccttcgctcctcctcctggggatccaccactggcacccacttgaagatacgaagggaagtgtcgcccacagtcacccatcgcttctcccatctccggaccttctcgatggtcgccatcaccttcttgatgtcatccttggcccggctccgggtctcggcccgtacagtccggccggccatgctgcgggc

SEQ ID NO: 3782 - DNA, 686 bp, Homo sapiens
  misc_feature (1)...(686): n = A,T,C or G
aacncccccccccctcctngggtcngggtaaaaaaatnaaagntttccaagggaanccccctagaatttaaaaggcccaaangggggaatggtaaaggngatcanctcctttnaaaaacccccccnacacccggcccccgggagtgaagcaaccctgtcccnaagtcaacacagtangttagaattgaagctgggactccctcccactgtctcttctcttacctgctgaacaactcaatgtgtcaatttccttttacttcatgcagtcaaatcacgcccctacttttccaatcattccactgcccttcaggattttactagtcaaattgttaactttacctggaaacagttgtggaaatgactgccattatgttaacagggtcatatgaaaaacacttgtttatcaacatttatatgctttattgaaagttgacaagtgcaacagttaaatacagtgacaccttacaattgtgtagagaacatgcacagaaacatatgcatataactactatacaggtgatatgcagaaacccctactgggaaatccatttcattagttagaactgagcatttttcaaagtattcaaccagctcaattgaaagactttcagtggaacaagggatttacttccagcggtattccagcagctagatttccagattacnccaagtgagtaactggtggc

SEQ ID NO: 3783 - DNA, 744 bp, Homo sapiens
  misc_feature (1)...(744): n = A,T,C or G
ncctgtcgcntataaggntnntttagaaatgaancaatnaaaagggntnaatngnggaaggcaaganattccttaagcaaaaaannaatcggttggttnagnttnanaagnaaagnaacnnnttttncgggggncanagntaanctaatcggatnggannnttgaanncttnnnganncntggaatngnntggggggntttgtgtnggtnccactnanggganaggnctgnttggcaagnggggttnnntangtnttganagttgggnnnctgnaaaanttggggtnaagnnggcctnnaggaantgggcncaagtgttncnanaagnnagaattggttcctactgnctcnaagctggggaaattttttactctaattaagttacttntgaatttgccncnnttnantacctaccaacttcttctcttgaaccgnataacaaccaaaatggctttttcaccagacccatagcttgctcgattttgttgtcaatagctacacacacttgcaccagaggagctattatcaagtctcacagaagcgttntcagtcccnagnaaggatgacnaagannnnaattnaaaaatgtctcagttggtaaactccnagancnatcgccactggtctacaccattgggatttcatgcaattgcagccaaaaacaccctcgtggnaaaaaagagggaacaccagcagccttgtataagctagataaaatcttctggcttncctcgtgccgaattc

SEQ ID NO: 3784 - DNA, 665 bp, Homo sapiens
  misc_feature (1)...(665): n = A,T,C or G
ttttttttttttttttttttttttacaaaagggtctttatttgtaaaaagccaaaggggcccctggggcaacaggacaggcaggccggcttctcaggggtcaggggcatttgggcaaatgcccttgagtgggggggcataggcagctatgcggttggtcctgagccctgcgatgctggctgggcggggggctgtgtggtgccctgtggctgggtggtggcagggggggagccagtctgcagctgggcctgaaactgggcaagctgctcaggactggccagtgtcttcagcaaattgttctcctgctccagctgggaatttttctctattagttctttgatttgctctttgaggacctccacttcttctctgaccgcatacatcaaatggcttttcactagatccatagcttgctcgattttgttggcaatagctaccacacttgcaccagaggagctattatcctcgccatctccaccaggggtgtcgtcagcggtagcaccttcaacgggaaaagagaagcagaggctgctaggntgctgctactcccatctgaaactgctgacattcccccactgtcaccactgatagtctgaggtaagccaactaaggaggntccgctgcacgcctggcatcttcaatttggcttccaattgcctgagctaa

SEQ ID NO: 3785 - DNA, 581 bp, Homo sapiens
ttcctgagcatgaattaaaccatttctcagatatctgccaagctgcatgaggtcccggtatatccatgctaattctcggattaacctttaattcacccaattaagaaatttctccaagccataagcatatgagtgtttaatactggaaaagagataatggcatatgtcagtctcacgtctctttcgcagcgagcaatgaaatgggtgactgtggaggcagattctccctagcacatcttctccgtctgttcagttcacacgcagcagccagttctgcgggggcataggcagctatgcggttggtcctgagccctgcgatgctggctgggcggggggctgtgtggtgccctgtggctgggtggtggcagggggggagccagtctgcagctgggcctgaaactgggcaagctgctcaggactggccagtgtcttcagcagattgttctcctgctccagctgggaatttttctctattagttctttgatttgatgtatgcggtcagagaagaagtggaggtcctcaaagagcaaatcaaatggcttttcactagatccatagcttgctcgattttgttgtcaat

SEQ ID NO: 3786 - DNA, 557 bp, Homo sapiens
  misc_feature (1)...(557): n = A,T,C or G
tttaagcatatgagtgtttaatactggaaaagagataatggcatatgtcagtctcacgtctctttcgcagcgagcaatgaaatgggtgactgtggaggcagattctccctagcacatcttctccgtctgttcagttcacacgcagcagccagttctgcgggggcataggcagctatgcggttggtcctgagccctgcantgctggctgggcggggggctgtgtggtgccctgtggctgggtggtggcagggggggagccagtctgcagctgggcctgaaactgggcaagctgctcaggactggccagtgtcttcagcagattgttctcctgctccagctgggaatttttctctattagttctttgatttgctctttgaggacctccacttcttctctgaccgcatacatcaaatggcttttcactagatccgtgagggtattggaagctgtggaactttttgaagagaggaaaacttgctcaagctgcatttaggaagatttgataggaagatacagtgtggattaaaagatggtgaggacctctgttcccgtgtca

SEQ ID NO: 3787 - DNA, 402 bp, Homo sapiens
gtcgacgtttctgtgcatgttctctacacaattgtaaggtgtcactgtatttaactgtcgcacttgtcaactttcaataaagcatataaacatatgcatataactactatacaggtgatatgcagaaacccctactgggaaatccatttcattagttagaactgagcatttttcaaagtattcaaccagctcaattgaaagacttcagtgaacaaggatttacttcagcgtattcagcagctagatttcagattacacaaagtgagtaactgtgccaaattcttaaaatttctttaggtgtggtttttgtcatgtagcagtttttatgtagatctatatataaaagtccacacctcctcagacaggcaatgaaacaactaaatttcaatctgtagtcgacgc

SEQ ID NO: 3788 - DNA, 386 bp, Homo sapiens
  misc_feature (1)...(386): n = A,T,C or G
aaaacttcnttgaaaccaccaactgtactatatgtttcaattagcagttcctgggccaaagtgtgtttgttgatgtttgcgaaagtgtcttcccactgctttatgacccatttttaactcgaataagaaaatcgcttgaatttgctttttgtctaacatcatttccatagtctcagcttccagcagttctggaacangctcctccttggtcagcattgggggttcgtcggtgctgccagcagttatgcccccgggatctctctcttgncccagccgtgggggctgagcctcctcangggacccttctgggggtccggcaggtgacacangggcggctgggctgggggtgcccccanggactgggctctgtgcccttttgcagggaa

SEQ ID NO: 3789 - DNA, 317 bp, Homo sapiens
tttttacaaaagggtctttatttgtaaaaagccaaaggggcccctgggcgaacaggacaggcaggccggcttctcaggggtcaggggcatttgggcagatgcgcttgagtgggggggcacctccgagtcctctgtgtcaccctgggctgcctcagggacaggtggcactggctcaaagacagggtaagcttcgggggcctggagaggaagggtggacaggcgtgacgtccacagaacccaggcgtccagcatctgagcctctgccttctccaaagcctccactcccctcccctcctgggcccgggagcaagcccagg

SEQ ID NO: 3790 - DNA, 276 bp, Homo sapiens
cgcgtgacgcgcgtcgacagtggactgtaactactatttaggttgtacagattgaaatttagttgtttcattggctgtctgaggaggtgtggacttttatacatagatctacataaaaactgctacatgacaaaaaccacacctaaatagtagttacagtcctctattgtacaaaatagttacactacatacacaaatatacaataagcaaaacaaccttcatggtaagatagcctaggtgccagctacctgtcaccattttgtcactgtctgacc

SEQ ID NO: 3791 - DNA, 1494 bp, Homo sapiens
ctggaagaattcgcgtggcaggagaggcggggcaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgcgtaatgcgagaccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtcttcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaagtcgttccatcataatctatgatcttgtacagcacttatagaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttactgcagaacatagagaaaaataaaagcctaacgaatagtaaaaaaaaaaaaaaaaaaacact

SEQ ID NO: 3792 - DNA, 3190 bp, Homo sapiens
  misc_feature (1)...(3190): n = A,T,C or G
cgtgggcggacgcgtgggatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaggaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacataaaaaaaaaaaaaaaaaaaaaaaaaaaaaaaaaaaaaaaaccaaaaaaaaaaaaaaaaaaaaaaaaaaaaaaaaaaaaaanggaaaaaaaaaaaaaaangggggggc

SEQ ID NO: 3793 - DNA, 432 bp, Homo sapiens
  misc_feature (1)...(432): n = A,T,C or G
agctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatgggatttttgtgggtgtggggccaatatgggtgtttacattatataattcctgctgtgggcaaggtaaagcacactttttttttctccntaaaatgttttnccctgtgtatccctattaggggaactgggttttggttaattatggattcctttattttcacnccctttttttggggggtntaggcnggtaatgcctnatttncctgggaaagggaatttccccattttccngggaaatggtaatccattggaggccntggaa

SEQ ID NO: 3794 - DNA, 342 bp, Homo sapiens
ttttaacacaaaaggtggccccagcaccttgggtcttgaaccccctagccaacttccctggcaaggtcaagcctactcaactgctgagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactg

SEQ ID NO: 3795 - DNA, 535 bp, Homo sapiens
  misc_feature (1)...(535): n = A,T,C or G
gaaaaataaaactttattaaatcaaaaaaaaaaaaaaaaaaaaaaaaaaaaaaannntcgggnttcagtagtacacatacanctaattnattnganctatatgttgangacatctaccagtttcnccaaatnccttttttaaaactcatcacagaagattggtgaaaatgctgagtatnccacttttcttcttgcatgcatgccagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacataaaanaaaaaaaaaaaaaactcggaaatacccagtaaaatgttgaagaaggatggaggatttcttcatatctgacgtttctgaaaccctttgtgtctgctgttgtgtgaagattgacatttaccatgattttccttagttactgcagaacatagngaaaaataa

SEQ ID NO: 3796 - DNA, 308 bp, Homo sapiens
ggcacgagcacaaatatgatctgcaggacccagaagcgcacatgagagattgggaaagacttgtcatagcagacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgc

SEQ ID NO: 3797 - DNA, 304 bp, Homo sapiens
  misc_feature (1)...(304): n = A,T,C or G
tctctctctctctctctctctctctctctctctctctctctctctctctctctnctcgtgccgaattcggcagagttnctcctgatgtctatattagcgctcatcttcatcatgggcaacagcgccaaggaagctctggtctggaaagngctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggcccc

SEQ ID NO: 3798 - DNA, 2469 bp, Homo sapiens
ttttttttttttttttttttttcaatttattattattttttatttattgagacagagtctcactgtcacccaggctggagtgcagtggcgtggtgtcagctcacagcaacctccacctcccaggttcaagtgaatctcgtgcctcagcctacggaacagctgggacaacaggctcccgccaccatgcctggctacttttttttttttttgtgccaggatttcattctgtcacccaggctggaatgcagtggcaccatcatagttcactgcagccttgaactgggcttagcctcccaagtagctgggactgcaggcgctcaccatcatgcccagccaaaactgaagacttactgggctatgtggtggataagtcacagctgaagagagacttagggaagtggaagggagaactgtagaagttacccagtgggcagcacaggcccttggtcagtgtgagggaggccgagccaggaggaggaggacaataagaaggcctaacaggcatctgaagattccagaaggaagggccagaggaggagatggcttaacttttccagaattgctaactacggggccctgggagtcagggagcaagcaggatgtcgaagggtcactgagagcctgaagttctggagggcagagccatgtattggacagagcctcactctaggatggcgaaggggcagtgagagccttaagttctggggggcagagccatgtattggaccaagcctcactccttgagggagaagtgcattttgtcgttgatcatcttgcgctcggggttgagtcgcttgaggatctgggccaacacgttcactgtctgctcgctgctcagccctgtcttcttggtctggaactttttcagcaggtccttagtggtcatgggcttccgtgtcaggtagcggcgcacggcatcctcagtcacctgcacgtcgccgctgttgggtgttgtcttgcctgatggtggctggggtgtcgacttcccagacaggctctggggtcccgtgtccagccgcaaccgcttggctgcaggcatctcgctcacccgcttcccttgctcgagtttgctggcagccgcccgcagggtggaggaggtgctgccaccctctgcgctgggcgtgcctgggcggctgttgccccttgagctccctcccgacggcttccgctctctcttgggtggcgtcttcttcttcgccatgaagagggctgaggaggcctcgctgtcaatgtcgctctcctctgagctgtccgactcctcgctgctgtctttcctgcgcttcttctcctgcggggtgggtgccttcttctcctcctcctcctccttgtcctcctcaggcggcttctcctcctcactctcctcactactgtcgctctgctcatcgacacccttgggcccctcctcctgctgcggcgccttggccttgctctcaggctcttcttgggagctactggagccgtctgacatgtagtccacctcttggccctcgaagtccccatcatcgctgtcctcgaaggcctcgtcgtctgaacccttcttcttcttctttttcctgccgcccttggccagcggcgccttcttcttggccttggggactctgcccccctcctcaccactggcatcactggcatcggacgacatctccaggtcgtcctccaggtcgtggatgcgcagctcgctcgccttcctgcggccacgtttctccttctcctcctcatcctcgtcctggtcctgatccttgagccgccgctgctgcatgatgctgaagtggttcagcaccttgttcctcctctcccactcctcctcggcctcctcggcagtgagcgtgcgatgccgggccagcggtgtgaaattgtaccagttgtgcacggggaaggcctcgaaggccccgtcggggcactgggtgaagatgtagtaggacgtgttctctgttacgcctcccttcttgatgcccttgaacttcctgcctgatttgccgttgacccggagcagccagggctggtcctcgggccggaactccttgaggacgatgccgtacttcttcctccgagcctcctcccgaagcttgcggttgaactcactgcccgcgcccgattcgggcatctcctcctcttggtagattttcttgttgctcaagtcccgctccagccgagcctgattccacgtagcaaagttgactttgtcggctgcattaaaagccatgatgttatattttttggttgtattcttaggaactcgaacgacgtattcagtgacattctggctgctagggcctagggccgccatgggcaatggtcagtggttccgatctggtccgacccgggttcctttcgtctcctctggcgtgcgcgtccctcgatcccggggaagccgccgctcggtgtcgggtctctgtgcctgagcgaggaccccaaccctaggcgcctctggcgctgggaaaaggtaaccggaagaggcgctcaagctac

SEQ ID NO: 3799 - DNA, 3768 bp, Homo sapiens
  misc_feature (1)...(3768): n = A,T,C or G
agacaaggcaaatttaagtaggctcatggcttttccagttgggttggaaagttcctctccgatgactgttatattctcaaagaaatatgaggagaggggcagggcatggtggctcacatccgtaatcctagcaaatcatgagtgcctacagccaacgccttcttcgctcactggccaactggaaacttcagtccccccatgcctcccgcctctcacccaggggccaataggaatgatcagaggttcgcaacttagtgtcatcaagcatagtaattgcaattggctattggagctgtcgatcgtggagtatgcggggccgtccagcttgcctatataagacgaggacannacgccgccgcctgtgtcatccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaaaaaaaaaaatgtattcaagtgatttataaagatggggtgtagtctaaaaaacaaaacttgaaagtaagagggtttagtaactgggccgggcgcggtggctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccaggagaattgcttgaacctggagatggaggttgcagtgagctgagactgccactgcactccagcc

SEQ ID NO: 3800 - DNA, 2366 bp, Homo sapiens
  misc_feature (1)...(2366): n = A,T,C or G
cacgggctcattgcggtgtgcgccctgcactctgtccctcactcgccgccgacgacctgtctcgccgagcgcacgccttgccgccgccccgcagaaatgcttcggttacccacagtctttcgccagatgagaccggtgtccagggtactggctcctcatctcactcgggcttatgccaaagatgtaaaatttggtgcagatgcccgagccttaatgcttcaaggtgtagaccttttagccgatgctgtggccgttacaatggggccaaagggaagaacagtgattattgagcagagttggggaagtcccaaagtaacaaaagatggtgtgactgttgcaaagtcaattgacttaaaagataaatacaagaacattggagctaaacttgttcaagatgttgccaataacacaaatgaagaagctggggatggcactaccactgctactgtactggcacgctctatagccaaggaaggcttcgagaagattagcaaaggtgctaatccagtggaaatcaggagaggtgtgatgttagctgttgatgctgtaattgctgaacttaaaaagcagtctaaacctgtgaccacccctgaagaaattgcacaggttgctacgatttctgcaaacggagacaaagaaattggcaatatcatctctgatgcaatgaaaaaagttggaagaaagggtgtcatcacagtaaaggatggaaaaacactgaatgatgaattagaaattattgaaggcatgaagtttgatcgaggctatatttctccatactttattaatacatcaaaaggtcagaaatgtgaattccaggatgcctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggctccagggtttggtgacaatagaaagaaccagcttaaagatatggctattgctactggtggtgcagtgtttggagaagagggattgaccctgaatcttgaagacgttcagcctcatgacttaggaaaagttggagaggtcattgtgaccaaagacgatgccatgctcttaaaaggaaaaggtgacaaggctcaaattgaaaaacgtattcaagaaatcattgagcagttagatgtcacaactagtgaatatgaaaaggaaaaactgaatgaacggcttgcaaaactttcagatggagtggctgtgctgaaggttggtgggacaagtgatgttgaagtgaatgaaaagaaagacagagttacagatgcccttaatgctacaagagctgctgttgaagaaggcattgttttgggagggggttgtgccctccttcgatgcattccagccttggactcattgactccagctaatgaagatcaaaaaattggtatagaaattattaaaagaaccactcaaaattccagcaatgaccattgctaagaatgcaggtgttgaaggatccttgatagttgagaaaattatgcaaagttcctcagaagttggttatgatgctatggctggagattttgtgaatatggtgaaaaaggaatcattgacccaacaaaggttgtgagaactgctttattggatgctgctggtgtggcctctctgttaactacagcagaagttgtagtcacagaaattcctaaagaagagaaggaccctggaatgggtgcaatgggtggaatgggaggtggtatgggaggtggcatgttctaactcctagactagtgctttacctttattaatgaactgtgacaggaagcccaaggcagtgttcctcaccaataacttcagagaagtcagttggagaaaatgaagaaaaaggctggctgaaaatcactataaccatcagttactggtttcagttgacaaaatatataatggtttactgctgtcattgtccatgcctacagataatttattttgtatttttgaataaaaaacatttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaataaaaatttgtttaaagttaaaaaaaaaaaaaaaaaccaagggggggaaacngnttcccnttttgttttnntnttgttgntttnnttnttnntgtggnnttttnttt

SEQ ID NO: 3801 - DNA, 1383 bp, Homo sapiens
  misc_feature (1)...(1383): n = A,T,C or G
tctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgccccagaagaatccatgtatcaaaaggagagagaaaccctcctcgttttgccagcatggcacgtttgagtacgaatatctcagcgatgggagtctttgggatgaatgggaaaacagccaagggaaccagttggaaaaacatgtaagatgccaaggacaatttgggaaggtgaaggggatggccctcattggactctcggccaactctttcgcgccggatctcgttgagacgacgggagtatttaagacgctggaggatcttcaattcaggaattgccgaagcgaaaagaatgcatttggggcaaggggggaacgacgtaggaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaantttccacctctaggaggtggtggtggnataggttatgaagctaatcctggcgttccaccagcaaccatgagtggttccatgatgggaagtgacatggtaagaatgattgatgttggntgatattggngtgctcatcacatgaggnnggttagatacttctcaaganatcaacagngtnagtcaatcaaggngggaagccacaagaagcttgnaacnttnttggttcagtnanttnccccagaaacccacaaaaggggtggnnggggnttaccntnacnnnnccgnanataggatntcnccgtctcnttntacttttttnnannnnnnnnnnnnttccnnttcntccca

SEQ ID NO: 3802 - DNA, 802 bp, Homo sapiens
  misc_feature (1)...(802): n = A,T,C or G
ggcatgggaagcaattccaggtgtcctcagggtggggattgcaagttggtgccctccctgggcaaggttttcccttttcctcctaatcctgtcagggtcatgatccttgagcggcgctgntgcatgatgctaagtggttcagcacctgttcctcctctcccactcctcntcggcttcctcggcagtgagcgtgcgatgccgggccagcnggtgtgaaattgtaccagttgtgcacgggnaaggcctcgaaggcccagtcggggcactgggtgaagatgtagtaggacgtgttctctgttacgcctcccttcttgatgcccttgaacttcctgcctgatttgccgttgacccggagcagccagggctggtcctcgggccggaactccttgaggacgatgccgtacttcttcctccgagcctcctcccgaagcttgcggttgaactcactgcccgcgcccgattcgggcatctcctcctcttggtagattttcttgttgctcaagtcccgctccagccgagcctgattccacgtagcaaagttgactttgtcggctgcattaaaagccatgatgttatattttttggttgtattcttaggaactcgaacgacgtattcagtgacattctggctgctagggcctagggccgccatgggcaatggtcagtggttccgatctggtccgacccgggttcctttcgtctcctctggcgtgcgcgtccctcgatcccggggaagccgccgctcggtgtcgggtctctgtgcctgagcgaggaccccaaccctaggcgcctctggcactgg

SEQ ID NO: 3803 - DNA, 972 bp, Homo sapiens
  misc_feature (1)...(972): n = A,T,C or G
gggctactggggacaatctnactgatgccaccttccccgtcctcccatcctcagcgacgtgcaggtgactgaggatnccgtgcgccgctacctgacacggaagcccatgaccactaaggacgatggtcttcctgaaaaacttgcccagaagaatccaatgtatcaaaaggagagagaaaccccctcctcgttttgcccagcatgcacgttgaggtcgaattctcagcgatgaagtcttggatgaaatgggaaacagcaaaggggaccaagtgaaaaaaacatgaagatgcaaaagacaatttggaaagtgaaatggaggatgcctatcatgaacatcaggcaaatcttttgcgccaagatctgatgagacgacaggagaaattaagacgcatggaagacnttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatggtaagaatgattgatgttggctgatattggagtgctcattcacatgaagtggatagatacttctcaagacatcacacagcgtgagtcaatcaaggagggaagccacaagcagactgacaacgtttctagcaggatcaggtgagctgtgtccagaaaaccaacgagaaggagtggaaggaggaatgaacgtttcattctcgttaataaaggcattatcctaattaaaaaaacaaaaaaaaa

SEQ ID NO: 3804 - DNA, 602 bp, Homo sapiens
tgccgcccttggccagcgcggccttcttcttggccttggggactctgcccccctcctcaccactggcatcactggcatcggacgacatctccaggtcgtcctccaggtcgtggatgcgcagtcgctcgccttcctgcggccacgtttctccttctcctcctcatcctcgtcctggtcctgatccttgagccgccgctgctgcatgatgctgaagtggttcagcaccttgttcctcctctcccactcctcctcggcctcctctaggatggcgaaggggcagtgagagccttaagttctggggggcagagcactgtattggaccaagcctcactccttgagggagaagtgcattttgtcgttgatcatcttgcgctcggggttgagtcgcttgaggatctgggccaacacgttcactgtctgctcgctgctcagccctgtcttcttggtctggaactttttcagcaggtccttagtggtcatgggcttccgtgtcaggtagcggcgcacggcatcctcagtcacctgcacgtcgccgctgttgggtgttgtcttgcctgatggtggctggggtgtcgacttccagacaggctctggggtcccgt

SEQ ID NO: 3805 - DNA, 895 bp, Homo sapiens
taatatctgtaattcaagaccatcctttcaaaatgtaccaagatatggctaaacgagaagatctggctcctaaaatgtgccaagaagctgctgtacccaaaatccttccttgtccaacatctgaagacacagctgatctggcaggatgctctcttcaagcatatccaaaaccagatgtccctaaaggctatattcttgacacagaccaaaatccagcagaaccagaggaatacaatgaaacagatcaaggaatagctgagacagaaggcctttttcctaaaatacaagaaatagctgagcctaaagacctttctacaaaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtatcaagaaatacctgggcttgaagaatattcacctgaaatataccaagaaacatcccagcttgaagaatattcacctgaaatataccaagaaacaccggggcctgaagacctctctactgagacatataaaaataaggatgtgcctaaagaatgctttccagaaccacaccaagaaacaggtgggccccaaggccaggatcctaaagcacaccaggaagatgctaaagatgcttatacttttcctcaagaaatgaaagaaaaacccaaagaagagccaggaataccagcaattctgaatgagagtcatccagaaaatgatgtctatagttatgttttgttttaacaatgctcaaccataaagttgtggtccaatggaacatacagcttaatagattatgcggt

SEQ ID NO: 3806 - DNA, 974 bp, Homo sapiens
gtgtcatcacagtaaaggcaagtgtgtttgtatttttaaagataattttgagttatcttatgatcaaaagtttgagttatctgatgatcaaaactgaatttttcaaacagaaaaattctgttttaaaaacagtgctttttttattccttcatatgtagtctcagcacatgtatagaataaagtacttactgtgttttatgtgaattagcctttgctgcatgaaatgaatccatcctaacttaaatgattattcaaataagcacttttgggattttttgcagaagtgtaattggatgtcctgggctgtttcatactctaccctgcatctcttatggccagaggggtctgtttttattaatctgggcctgtaaattccatgttttgtgttcaatggaaatccatatacctaattctttggacttttccatagggatggaaaaacactggatggtgaattagaaattattgaaggcatgaagtttgatcgaggctatatttctccatactgtattaatacatcaaaaggtcagtaacatgtggaattccagggatgccctatgttctgttgagtgaaaagaaaatttctagtatccagtccattgtacctgctcttgaaattgccaatgctcaccgtaagcctttggtcataatcgctgaagatgttgatggagaagctctaagtacactcgtcttgaataggctaaaggttggtcttcaggttgtggcagtcaaggccccgtgtccccaatgtcttcagtgggggccccctcttgggtcccctcctctgccatcacctgaagacccccacgccaaacactgaatgtcacctgtgcctgccgcctcggtccacttgcggcccgtgtttgactcaactcagctcctttaacgctaatatttccggcaaaatcccatgcttgggttttgtctttaaccttgtaacgcttgcaatcccaataaagcattaaaagtcatga

SEQ ID NO: 3807 - DNA, 847 bp, Homo sapiens
  misc_feature (1)...(847): n = A,T,C or G
ccccaggcccctggaaagggccaaagccccnatcccgggaaangccacccggaagcccaaanaatggccncccctacaaaaaatgccccccccttgttttaaaaaagaagaaatgccatattgaaagtaagtttgaatgatttgtttgggccatataggaaagcacgctggtgcctaagtattttttaaatggttatgtaaagcaaagctgaactgtaaatccttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagccaccacgcctggcctcttaatttcttttagcaacattttgtagttttcagtgtatgagtctttcacctcctgggttaagtttattcccaagtattttattttatcttattatttatttatgtattttgaaacagtcttactctgtcacccaggctggagtgcagtggctcaatctcggctcactgcaaacctccacctcccaggttcaagcgattctcctgcctcagccccccaagtagctgggattacaggtgcttgccactacacacggctaatttttgtatttttgggtgacagagcaa

SEQ ID NO: 3808 - DNA, 565 bp, Homo sapiens
aaaacacaccaagaatcagctgaacctaaataccttcctcataaaacatgtaacgaaattattgtgcctaaagccccctctcataaaacaatccaagaaacacctcattctgaagactattcaattgaaataaaccaagaaactcctgggtctgaaaaatattcacctgaaacgtattcaagaaatcattgagcagttagatgtcacaactagtgaatatgaaaaggaaaaactgaatgaacggcttgcaaaactttcagatggagtggctgtgctgaaggttggtgggacaagtgactgttgaagtgaatgaaaagaaagacagagttacacgatgcccttaatgctacaagagctgctgttgaagaaggcattgttttgggagggggttgtgccctccttcggatgcattccagccttggactcattgactccagctaatgaagatcaaaaaattggtaaaaagttaccttttaaatgagtttgtggcctgattttagtttttcttagaataataatgttgcagtcccctaaatggaatagcacattcatttcctgaataaca

SEQ ID NO: 3809 - DNA, 687 bp, Homo sapiens
  misc_feature (1)...(687): n = A,T,C or G
gatctttgatagtngagaaaattatgcaaagttcctcagaagtnggttatnatgctatggctggngattttgtgaatatggtggaaaaaggaatcattgacccaacaaaggttgtgaganctgctttattggatgctgctggtgtggcctctctgttaactacagcagaagttgtagtcacagaaattcctaaagangagaaggaccctggaatgggtgcaatgggtggaatgggaggtggtatgggaggtggcatgtnctaactcctagactagtgctttacctttattaatganctgtgacaggaagcccaaggcagtgttcctcaccaataacttcagagaangtcagttggagaaaaatgangaaaaagggctggcttgaaantcactnttaaccnnttanggttgcttgggtttcangttggccanagttttnnntnntggntttnctngntggccattggccccntnncctnccggtnnnnttgnattttggggttgtnngatntnnancgcntttgtgccnnnctgganagttgggggtnanggnnnttncnngggnntgtgngnngntnnngnnnngggggggggtnntggggnnnnggntntgnnttttgtnnnggggntgnnnntnnnnncnnnnnnngnnnngnngggngngnnngngntntggntgggggngggt

SEQ ID NO: 3810 - DNA, 615 bp, Homo sapiens
  misc_feature (1)...(615): n = A,T,C or G
aaacatgtaacgaaattattgtgcctaaagccccctctcataaaaccaatccangaacnacctaattntaaggntnatnaattnaaatnaaccnaggaactncngggggctnaaaaatattcacctgaaacgtatcaagaaatacctgggcttgaagaatattcacctgaaatataccaagaaacatcccagcttgaagaatattcacctgaaatataccaagaaacaccggggcctgaagacctctctactgaggacatataaaaataaggatgtgcctaaagaatgctttccaggaaccacaccaaggaaacaggtggggccccaaggccagggatcctaaaggcacaccaggggaggatgcttaaaggatgctttttactttttccttcaagggttgggcgctttatagcaccaaggtaggtacatctcccccagagtagtgatttacaactttctctggacaatcctggggtattccctgttatttcaatgggatactgtggaatttccttggactagttttaagtgancatatttttcatggcaaccaacgtctgtcttgggctatttcanagggtttaaaaaattggaaatggcaggctgtactttagt

SEQ ID NO: 3811 - DNA, 396 bp, Homo sapiens
gggtcctggcccgggccagagcggcactaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcagactcttccaagcccgtcgttgctcagggacccggccccgctcccggagtaggcagcgcaccaccagcctccagctcggccccgcccgccactccaccaacctcgggggccccgcagttccgggccaggcctagaggaatggggctggaactccacaggatatggtagagggagagaagagtacgaaggcccagataaaaaacgccgattttagatgtgatattt

SEQ ID NO: 3812 - DNA, 593 bp, Homo sapiens
  misc_feature (1)...(593): n = A,T,C or G
ntggnccntgcccagatggaagaacacntgaggcgccaaagagaggaaagttacagccgaatgggctacatggatccacgggaaagagacatgcgaatgggtggcggaggagcaatgaggtgcggggcctgtgggtggacagggtcctagaggaatggggcctggaactccagcaggatatggtagagggagagaagagtacgaaggcccaaacaaaaaaccccgattttagatgtgatntttaggcttccatcccagttngtttggttttttggtttagttcccancctttnaattcctggaattttagtaagaaagctatctttttnatggattgttagcaagnttattggacctaatattnggtaaatggccttgttggggacagggtaaaaattattgtnatncaagngttggggcacaaggagaatttnnnccccccnnnnatcccttntatnncccctttnnctacttttttatcccccncaaagtttttggaggccccccggngnccactgatttccaaggngnccccacnnnnnnnnntcccttgnccccccaantattanaaattngtctccctcccccccnnn

SEQ ID NO: 3813 - DNA, 354 bp, Homo sapiens
  misc_feature (1)...(354): n = A,T,C or G
atgggcctggggacttacttaggaactcgaacnacgtattcagtgacattctggctnctaggnccctgngnaaagaggaagcggtgagtgaggggtcgccgaggtcgccgtcggaacccccgaaccccgcnaaatccanactcactagggccgccatgggcaatggtcagtggttccgatctggtccgacccgggttcctttcgtctcctctggcgtgcgcgtccctcgatcccggggaagccgccgctcggtgtcgggnctctgtgcctgagcgaggaccccaaccctaaggccctctggcgctgggaaaaggtaaccggaagaggcgctcaagctactcggtctacgcttct

SEQ ID NO: 3814 - DNA, 342 bp, Homo sapiens
  misc_feature (1)...(342): n = A,T,C or G
gccgtggggaaggagccgcatgtnctttgtgctggtgctataggtcaggcgccggccggggcggcctctttagcttgcgctagtggctgatgttccgaagctgcggcgccttccgtcattcaggcgtagtggctggcggaggtcagccaggctcagcatctcacgttgcttgctctgttgcacaggtgggcatgtttgttctgcagcgcaccacgggtggtagttctaatgatctttttgcttccatccccagaaatgcttcggttanccacagtctttcgccagatgagaccggtgtccagggtactggcttcctcatctcaattcggggcttatgccaaa

SEQ ID NO: 3815 - DNA, 481 bp, Homo sapiens
  misc_feature (1)...(481): n = A,T,C or G
attttatgtaagaataattttagatttcccccccaccatgaagtttcttcctatttttttatgctgtaacttacccccaatctttatctctggatttttactctttaaattttgaagttgactagcattttcaaacctttattttatacccttgtcttttatattaactttttcttattattctttaggtaagaatgattgatgttggctgatattggagtgctcattcacatgaagtggatagatacttctcaagacatcacacagcgtgagtcaatcaaggagggaagccacaagcagactgacaacgtttctagcaggatcaggtgagctgtgtccagaaaaccaacgagaaggagtggaaggaggaatgaacgtttcattctcgttaataaaggcattatcctaattaaaaaaaaaaaaaaaaaaaaaaaaaaaaaaaaaaaaaaaaaaaaaaaaaaaaaaaaaaaaagggnggncg

SEQ ID NO: 3816 - DNA, 576 bp, Homo sapiens
  misc_feature (1)...(576): n = A,T,C or G
atcaccctggtaacccaacttgaaatcccntcgggaagacctccccnatccaagaatncagaaaccttnaagaaatccnatttgagccaagaggngggncccnccgtagaagaagagggaanagatgatgattcgtcccccgtgagatggaaganccnaatgagccccccaagagaggaaagttacacccgaatgggcggcggaggancnatgaacatgggagatccctatggttcaggaggccagaaatttccacctctaggaggtggtggtggcataggttatgaanctaatcctggcgttccaccagcaaccatgagtggttccatgatgggaagtgacatggtaagaatgattgatgttggctgatattggagtgctcattcacatgaagtggatagatacttctccagacatcacacagcgtgagtcaatcaaggagggaagccacaagcagactgacaacgtttctagcaggatcaggtgagctgtgtccagaaaaccaacgagaaggagtggaaggaggaatgaacgtttcattctcgttaataaaggcattaccgatcgttaanagnn

SEQ ID NO: 3817 - DNA, 360 bp, Homo sapiens
  misc_feature (1)...(360): n = A,T,C or G
caactcctcgtccagtcattgtggaaccacttgaacaactagattgatgaagatggtcttcctgaaaaaacttgccccagaaagaaatccaatgtatcaaaagggagnagaggaaccccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagccaaatctcgccaagtaggaaaggaaaagggcaaatacaaggaagaaaccattgagaagatgcaggaataaagtaatcttatatacangctttgattaaaacttgaaa

SEQ ID NO: 3818 - DNA, 514 bp, Homo sapiens
  misc_feature (1)...(514): n = A,T,C or G
gggtccaatggttgaatgggaagttgtatgggaagttgcatgattctaactcctagactagtgctttacctttattaatgaactgtgtacaggaagcccaaggcgttgttcctcaccattaacttcagagaagtcagtctggagaanatgaagaaaaaggctggctgaaaatcactataaccatcagttacttttttcagttgacaaaatatataatggtttactgctgtcattgtccatgcctacagataatttattttgtattttgaataaaaaacatttgtacattcctgatactgggtacaagagccatgttcccagtgtactgttttcaaattaaaacacgtggggcatttttacactattttgttaaaaaacggggttttgtttcttcccccccccagattggaaatttaaacccccttcttttggggggagagaataaattgtttccccaattggggaatttcccaattttgtgacaacctttttgtaattaaaatttgttttaaag

SEQ ID NO: 3819 - DNA, 373 bp, Homo sapiens
caaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatggtaagaatgattgatgttggctgatattggagtgctcattcacatgaacaggatcaggtgagctgtgtccagaaaaccaacgagaaggagtggaaggaggaatgaacgtttcattctcgttaataaaggcattatcctaattaaaaaaaaaaaaaaaaaa

SEQ ID NO: 3820 - DNA, 288 bp, Homo sapiens
  misc_feature (1)...(288): n = A,T,C or G
aaagtnacagccgaatgggctacatggaatccacgggaaagagacatgcgaatgggtggcggaggagcaatgaacacgggaaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatctt

SEQ ID NO: 3821 - DNA, 347 bp, Homo sapiens
ctcaaattgaaaaacgtattcaagaaatcattgagcagttagatgtcacaactagtgaatatgaagctaatcctggcgttccaccagcaaccatgagtggttccatgatgggaagtgacatggtaagaatgattgatgttggctgatattggagtgctcattcacatgaagtggatagatacttctcaagacatcacacagcgtgagtcaatcaaggagggaagccacaagcagactgacaacgtttctagcaggatcaggtgagctgtgtccagaaaaccaacgagaaggagtggaaggaggaatgaacgtttcattctcgttaataaaggcattatcctaattaa

SEQ ID NO: 3822 - DNA, 340 bp, Homo sapiens
  misc_feature (1)...(340): n = A,T,C or G
tctggatttttactctttaaattttgaagttgactagcattttcaaacctttattttatacccttgtcttttatattaactttttcttattattctttaggtaagaatgattgatgttggctgatattggagtgctcattcacatgaagtggatagatacttctcaagacatcacacagcgtgagtcaatcaaggagggaagccacaagcagactgacaacgtttctaggtaagttaaatgattcttagtctgttaaactgtcttcagaaaggnccntgggtggtacnaaaataacaatactaatgtggggaccnttaattttttaattttttgagatgg

SEQ ID NO: 3823 - DNA, 628 bp, Homo sapiens
  misc_feature (1)...(628): n = A,T,C or G
ctgagcanngctgagactagaaccccatcttccccaccacgccacccctgtngttgctacaggagcacagtagtgaaaggcctgagctccaggtttgaaagacccaactggagcgtggggcgggcaggcaggggttagtgaaaggacacttccagggttaggacagagcatttagccttctggaagaacccctgcctggggtgggactgtgcaggccagagaaggtggcatgggcctgaacccacctggactgacttctgcactgaagccacagatggagggtaggctggtgggtgggggtggttcgttctctagccggggcagacacccagctggctgggtccttcctcagccttgcctcctcctgtccccaaccctttcctttcctcctgcttgcggactgctggtcccctctccttccctccttccagctgtttctagttaccacctacccctggccgtggactgatcagaccagcattcaaaataaaagtttgttccaagttgaaaaaaatggatgataccctgaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggg

SEQ ID NO: 3824 - DNA, 6119 bp, Homo sapiens
aatcttttttttttttttttttaaagctggaaggtgtttctatttggtatctttaaatgctatagatttgggattttaactaacagctttggctatagaaatgaagaacagacactgctgaatcttcatttgaatgctcaagtttcatggggcagggtggggggcgggatagctttgcaacccaaatttaagagaatcaggaggaaaacaaagcagcaaagaggcagctggtgcttactacctcttccactactacgcttcagactgacagaaaagcagctagctgctcctttaaattagcaatggttaattctaagcaggaaaagatgagctgcgaagaacagtaagaatcataaaggaaaattttaattttttcccccgactatttgtggagatgggaaataattgaaggggctggagtaggacaatgtgagtaaacagtttagacgtttacctggggcttgtcttatgctttgttgctgtcaacctaagtagtactcacagttcaccatcttttaagtgtggtatgtagaggacaggcctcaatataatagttcttcatatcttttgttagctaaatccgtatcactaggtattgccaataaataaatgaggcacaactcagatatatatggaatggcataaggtcaagaaaggcaatttgaaaggggagaagaacaatgctattgccatattccacaacatcccccttgtctgtgtacatatgctcaggtacatacatattctgacaactattcttgatattcatgggaatgtgggaaatctctactggatggtcatttagctagaagagctccttgatatgttaattactgattgatatctagtcacacttcttttgtagaagggtaagtaccaattttctttggttgttttctttttcaacattaatgttcaaagtaattgtagccaggtagaattttctgcagaaagacaaagtatatgccttaaggataacagcaaagcagaggacagagaagtcttaagaactggcttagcattcccctgacctctttacctagcaattctgcattaggttaatcttcattattcagaaccttttctgttttaacaacctcaactctgttacacattttcttttgaggtcaattttgatttattacacttgtcctctcctccctttcctcagtaataacattttttatattctaataatgtattttctactaatcctcttttgttctatcactgtaaatttcattagtaccataaaatctgtaaaatgttttttaaatgtatgtaacttgtattggaatttattacttttagaatatgatattgccaaaggaaatcttagttcacgtttagaaggcatgtgagttacaatattctaatgttgtagtgaaggcatagccaaatccctaccccttcttttttctttgtaggaatatcaagatcatattgagcaaatatttctggtaaattcttaaatgactaaagaaaaatgctgatttaggaaacaattttaggatcacattaataactatgatagtgttaggttatcatcttttatttctaaattatttgtaactccagtccaagagactgatagcagtcttcagaggaacttattaggagactaataatgacactgacacccacatgctgttaaaaaggtactaaggtttcaaaactgctacggaaaccggacaatgacttcaagatggtgagttatcacctgaattaaaatcaaggcactatggggttttttcccctcaaataaccctgaatcatttctgactaaaagaagcattgaaattgtgaaggataataaaaaagatttcaacaaatcccaaaagttaaaattcccatgattgagaatgttaaaaagtgcctaagatgttttgtgtgcaaattttacctctataactgaaacattcttgaaattactttcaggcttgttgaaaaccatttacgcaaatatttccaactatgaactataacaaaatatgcaatcaaaactcccagccacctaaaataaagcagtgcaaatcctattttcaaacataattgaaaaataatgaaatgagggatatttctgaataacttgaaaatcctgttgtatcaataatttaacctgaaaaaaaaaaatccattcccagcagcacatcatacctcactgaacaaactgtgacatcacagccaaagtatgaacaaaaaaacttgtgccccggaaaagtgaacagaacactactgtgttgtaaacaaaaggaaaaacaggatggatcagtttgcacatggtgtcagaatttcaggaaaggtgctcacacctgtaaggaagagataacgctttcatgcagcatacaaaatgttttgctttctctccttttatctagacatatacatatttttacatcatctgtacatagagaatttgaacccacacaacattctgaaagtaattactgttccatcattatctgaaaagggagaggggttgggggagggggtcgctaccaagtctactggactgtcttcatggcatcactgtaagcaaacccctgacatggcagtggtatgtcctctgtaacacttgataagaggcacagaaccactaaaagttactaacatcattagtgcctttctgattccctggaggtcatttcatagctgagcttcttaatatttggcaatatattctttttccatcaaaaaatatccaggcacctaaaacactgtcagaactggctgtgcccctatgatcacctcctgctggctggtatttaatgtacatctgtagcactaggcagcattttctctgccaactaattccaggaactagaacactcaatactgcatctcatgaaactgctggaactttccctcctttcctcaggtcatctgagtaactcttaatgggccatccccttcctcccttgatgtcaagagaggaagcacgtgtgctactgtggttgaaccttggaagggtcgggcaagctgtcagtcctgtgccggctgagttgctgctgttgctgagactgatgttgctggtgatgtgactgagggaaggtgctctgttgtagaggaaatgcagcagagagaatgagttgagttgagggattcccatggagcaacctagaagtctgtaaaaattgttgcggtggctgggtcagctgagcctgagatggttgctgaactgaagtgagctgctgctcctgggagctctgctgctgctgctgctgcgttactgacaatgtctgtgactgttgctgttgtgtagcaaaagtaggatatgcagtcaccacctggcccataagcatagtactaggtaccatgactgccccacaagctacaggagcagtcactaatttggtcacaagttgttgaccttgagaaaatcttatctgcctgtcctgagtgaatgtagttactgcagcactctgggtgctgttttgtggcatactagatggaatctggaccatgcttccggctgcaggctgagaaatcaccatagtgttatacagtggggctgtaagagtgctctgtgtctgactgggtagagatgtttgctgactgtgcccactcagtacattttgttgactctgagttgatgtactctgtaaagtctgttgttgtatcatgtgctgagttgtgccaatgtgtccagtattcattccactttgaatctggttagtaggaacaacttggccttgcatatttataggtgcaagttgctggatgttagatgaatttccagaagaaagttgaacggaaccaaaattcaacccaggatttgattgttgcaaaaacatctgcagcccctgaccatggaccatctgaagttgttcttgaatttttcttagttcttcttgttgccgatgaatatttgcttctatcatgcgtgtccgttgttccaattggtctttcagatgttgcatggctcctaattgagctgaaaactgaaactgggacatgccttgtggaattggtaaatttgtagcttgagacatcactggctgtgttaatgatgaaccaacagactgggaatttatggactgactactaaatgatgaccttctttgcaccatcttctcatgagctggtaaatgctgcctgggtggagtgctcgtatccgtcgggatcttggttggtgttgaggaagggtctgagacggccgtgtgagatgattttcttgaactccgagaagaggcagaaggggttgggctgtgatcaaacctttccaatgcttccttgagactgactgtgtttatacgattatctgacccagaatcttggcttttgtcagcagctgtctcaggaagagactcttcaatgccaagttctcgtcgtctttcagccctaacttctgcataacttactacagtgtgagtacaaacaataaactctggccttgaattccactgatggtaagtgatataataatgagtctgaagccaaatccactgttgccccttagtcaggaacctataataacatgatttgcctttcccatattgcattaagtgctcatgacattttgccaaattttctaggtcatccacatgatagtaatcatagcctgatgttcccagaacttcaaatggcaaataccctattatgggtggtgccctgtgatctagaaacagaaacttccattctaaactatgtctagatgtaaactcttcattgggttcttcaacagtgcacatttccttgatgaactgaggtgtagctaacctgacagtagctacaaaacaaactctatcttcataagatggcctatgtgtgcgttgtatagttccttcaaaaccattgtgtgctgaagaggatacactgtttaaagatttgaaatttcctataaattttacatattcataggtagatggctcctttgggtctattgttcctcgcagcatgtgacaacagaattctaactgattttttgattttaaatattctggggttaatgaatcactttccagcagatgagtagagagtattttataaacctctgaatgttccccttctgggataaaattaaatatactttgatccacaagatcagatggtaaatgttcaagtaatgaagttacactctcagacacatatattatgcttccatctgtcatgattgctaaaaaaaaaccatcaagagcctctaacattaattgtgtaaactcttcattactaaggaatgtaggtttccagtcctgtcgaatttcactagcatctgactgtgcagtgatttctttatgttttcgtaaaaaatcaatgcttttctgcagaacagtagatttgtccatctttctagcattaccaggaagcatggatcccagttctttaatgagaacattaaattgatctctacgtttcttttcagatttgtttctagatactcttttcgctttgtccttgtcatcttcttccaccaacccatcaaaaatactactgtcatctctgtcaacaatcgagctcattttactacagcttacggtaaacaacataacatactacgttttcgtcttgtagtagacatttgtacttctccttttgtactccttggatcttttaaactgattcttcaggaaactataggttcaaggtcctcttctatatgaccaaccataagtctcagaattctttgagctcaaaatgatgattgaaggtatctagtgagacttgccaagttctaaagattcatttaagaggactgtagaattatccaaaggcatcttacaatgtgatagaatcagctcctgagctccagcagctttgcaggaacaagtaaaaattcgggtgcgctcgcggcggcgccggccaggtttccttcggagcgctctcgctccagggggcccgggggggggtcatgggctgggttttactatatgataggcatgtggtttcacttccactccataacgctcctcatactaggcctactaaccaacacactaaccatataccaatgatggcgcgatgtaacacgagaaagcacataccaaggccaccacacaccacctgtccaaaaaggccttcgatacgggataatcctatttattacctcagaagtttttttcctcgcagcttgcacagaagcttcctgaacctaagggatccgttcccagctctccttaaat

SEQ ID NO: 3825 - DNA, 1039 bp, Homo sapiens
  misc_feature (1)...(1039): n = A,T,C or G
caccttgattacagcctcatganagaatctgaagtagagggtccagctaaactgtgcctggactcttgactcaccaaactaggagataacaagtgtgttgttttatatcactaaattttggagtaagttgttacacagctatagataactaatatactacacttctgacctgatataacaaaaaagaaaccagagttccaattctgactataatttcccagccagtgtctttagggaagatttttttttcccctcttgaaaccccaatttcagtattttcaaagtggggatattacctacccgataaaaatatctgatgtgtaaattatatttcataattcatataaataacctagccagagactagtacatcactgggaataaatggtagttttgagatcagacacatctctcatccaattttctttttagaggcaggtgagactctaaaatattaaattaaaaataagtagtaaagtataatcacatccctgttataagtgaggaaataaagtatttttgaaaaatagttttcctattaattattgagtttcatcttttattggggagaaattaaaaataattttttttaattataagaaacatactttgtcagcagctgtctcaggaagagactcttcaatgccaagttctcgtcgtctttcagccctaacttctgcataactacaaatggaaaaaataatcaaattttagtgtctggtcattcgtttaaaatagtgcacagctgtaactattcagtgttgttacgtgtctcatctgttcatctagactatttgctatgtgctacacaaacctaaaatatacctataatgtcttaatttaacttgcatttttctaggtatcttaaagtttcatacactgctgtaaacgatccataaccacacaatacttaaattaagaaaaataaataaaggaagtgtatgcttatctaaaaaaaaaaaaaaaaaaaaaaaaaaaaaaaaaaaaaaaaaaaaaaaaaaaaaaaaaaaaaggaaaaaaaaaaaaaaaaagggggccg

SEQ ID NO: 3826 - DNA, 426 bp, Homo sapiens
tttttttttttttttttttttttttttttttttttttttttacattcagggtttttatttcaaatttaaaaacattggctggagggggcatctcattaaaatcacattaaaaaatttgattaaaaaatcaaattattggtttctaatcaatcggtttacaattttaaaaataacaaaggaaatatgacaactaccttatctgcctgtcctgagggaatggagttactgcagcactctgggggctgttttggggcatactaaatggaatctggaccatgcttccggctgcaggctgaaaaatcaccatagtgttatacaggggggctgtaagagtgctctgtgtctgactgggtaaaatgtttgctgactgtgcccactcagaacattttgttgactctgagttgatgtactctgtaaaagctgttg

SEQ ID NO: 3827 - DNA, 415 bp, Homo sapiens
actctcagacacatatattatgcttccatctgtcatgattgctaaaaaaaaaccatcaagagcctctaacattaattgtgtaaactcttcattactaaggaatgtaggtttccagtcctgtcgaatttcactagcatctgactgtgcagtgatttctttatgttttcgtaaaaaatcaatgcttttctgcagaacagtagatttgtccatctttctagcattaccaggaagcatggatcccagttctttaatgagaacattaaattgatctctacgtttcttttcagatttgtttctagatactctgatgaaatgaaaaatatgcattttttaaacaatccatttaattacacaagtagtttaatacaatgttaatttagacatgacacagcatgtacctcggccgcgaccacgc

SEQ ID NO: 3828 - DNA, 3574 bp, Homo sapiens
  misc_feature (1)...(3574): n = A,T,C or G
tnctgtgggatcagagggcacgcctattacaaccagaaaactacaagtgnngcagcgaggatggatgaacaggctctattagggctaaatccaaatgctgattcagactttagacaaagggccctggcctattttgagcagttaaaaatttccccagatgcctggcaggtgtgtgcagaagctctagcccagaggacatacagtgatgatcatgtgaagtttttctgctttcaagtactggaacatcaagttaaatacaaatactcagaactaaccactgttcaacaacagctaattagggagacgctcatatcatggctgcaagctcagatgctgaatccccaaccagagaagacctttatacgaaataaagccgcccaagtcttcgccttgctttttgttacagagtatctcactaagtggcccaagtttttttttgacattctctcagtagtggacctaaatccaaggggagtagatctctacctgcgaatcctcatggctattgattcagagttggtggatcgtgatgtggtgcatacatcagaggaggctcgtaggaatactctcataaaagataccatgagggaacagtgcattccaaatctggtggaatcatggtaccaaatattacaaaattatcagtttactaattctgaagtgacgtgtcagtgccttgaagtagttggggcttatgtctcttggatagacttatcccttatagccaatgataggtttataaatatgctgctaggtcatatgtcaatagaagttctacgggaagaagcatgtgactgtttatttgaagttgtaaataaaggaatggaccctgttgataaaatgaaactagtggaatctttgtgtcaagtattacagtctgctgggtttttcagcattgaccaggaagaagatgttgacttcctggccagattttctaagttggtaaatggaatgggacagtcattgatagttagttggagtaaattaattaagaatggggatattaagaatgctcaagaggcactacaagctattgaaacaaaagtggcactgatgttgcagctactaattcatgaggatgatgatatttcttctaatattattggattttgttacgattatcttcatattttgaaacggcttacagtgctctcggatcagcaaaaagctaatgtagaggcaatcatgttggccgttatgaaaaaattgacttacgatgaagaatataactttgaaaatgagggtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagttcctatcagcatacatctgtgacattggagttcttcgaaactgttgttagatatgaaaagtttttcacagttgaacctcagcacattccatgtgtactaatggctttcttagatcacagaggtctgcggcattccagtgcaaaagttcggagcaggacggcttacctgttttctagatttgtcaaatctctcaataagcaaatgaatcctttcattgaggatattttgaatagaatacaagatttattagagctttctccacctgagaatggccaccagtccttactgagcagcgatgatcaactttttatttatgagacagctggagtgctgattgttaatagtgaatatccggcagaaaggaaacaagccttaatgaggaatctgttgactccactaatggagaagtttaaaattctgttagaaaagttgatgctggcacaagatgaagaaaggcaagcctccctagcagactgtcttaaccatgctgttggatttgcaagtcgaaccagtaaagctttcagcaacaaacagactgtgaaacaatgtggctgttccgaagtttatctggactgtttacagacattcttgccagccctcagttgtcccttacaaaaggatattctcagaagtggagtccgtactttccttcatcgaatgattatttgcctggaggaagaagttcttccgttcattccatctgcttcagaacatatgctcaaagattgtgaagcaaaagatctccaggagttcattcctcttatcaaccagattacggccaaattcaagatacaggtatccccgtttttacaacagatgttcatgcccctgcttcatgcaatttttgaagtgctgctccggccagcagaagaaaatgaccagtctgctgctttagagaagcagatgttgcggaggagttactttgctttcctgcaaacagtcacaggcagtgggatgagcgaagttatagcaaatcaaggtgcagagaatgtagaaagagtgttggttactgttatccaaggagcagttgaatatccagatccaattgcacagaaaacatgttttatcatcctctcaaagttggtagaactctggggaggtaaagatggaccagtgggatttgctgattttgtttataagcacattgtccccgcatgtttcctagcacctttaaaacaaacctttgacctggcagatgcacaaacagtattggctttatctgagtgtgcagtgacactgaaaacaattcatctcaaacggggcccagaatgtgttcagtatcttcaacaagaatacctgccctccttgcaagtagctccagaaataattcaggagttttgtcaagcgcttcagcagcctgatgctaaagtttttaaaaattacttaaaggtgttcttccagagagcaaagccctgaggactggatttccctgtgcctacttcatgatcatgaattccagttaatttataaagaggcgatttttgtgtgccattcacactggtctttttcacattgttttgagcttattgcagtatatgttttgggatttttctgtaaaatgggtgtaattttcctaatacaggtatgtaacaacaaaagaagttgcctgcatgccggtccaaattgttctgtataaagatgctcttaaaagacacaagagttatcctagaaccttaattcttttttatttgaaattttaagtcaagtcctttataaagaccatagcagtggaaaacagtgtactttttaaaaaattgctgaatataaaatctttgaaaattttctttatgtgtgaagacacaaagtatgggggaagacagcaatcaaaactaactttttgtagatagccatttcatttctttaaactgtttcaacgccaatatgtattctacaaaagagaatggttttaggctccagtgttatacttttttttatatatatatataaaaataaactttacgtagtgaaatctaaaaaaaaaaaaaaaaaaaaaaaaaaaaaaaaaaaaaaaaaaaaaaaaaaaaaaaaaaaaaaaaaaaaa

SEQ ID NO: 3829 - DNA, 396 bp, Homo sapiens
gagcgactagaggcgcgcggtcccggccagcaccgtctctggcgttgtagctgcggccgtggcggaggactacggcgacaaggacgagggccgctctcccagctctttgcgtgccgcgccgctccgctccgctggctgaccatttggagtgcaggctgggaggcgggatggagtgatagggaagatgtttataaattcttctgtgggatcagagggcacgcctattacaaccagaaaactacaagtataacagcgaggatggatgaacaggctctattagggctaaatccaaatgctgattcagactttagacaaagggccctggcctatttaaaaaaaaaaaaaaaaaaaaaaaaaaaaaagaaaaaaaagaagaaagaaaaaaaagaaagaaaa

SEQ ID NO: 3830 - DNA, 1135 bp, Homo sapiens
gcctaagtcagatgatgacgggtttgagatagtgcctattgaggacccagcgaaacatcggatactggaccccgaaggccttgctctaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtggctgaggctaaaggcttagaaagaaaaggaggatgctgaagaggctggagcagaccaggaagaaggcagaagccgtggtgaacacagtggacatctcagaacgagagaaagtggcacagctgcgaagtctctacaagaaggctgggcttggcaaggagaaacgccatgtcacctacgttgtagccaaaaaaggtgtgggccgcaaagtgcgccggccagctggagtcagaggtcatttcaaggtggtggactcaaggatgaagaaggaccaaagagcacagcaacgtaaggaacaaaagaaaaaacacaaacggaagtaagcagagctgccaggctcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3831 - DNA, 446 bp, Homo sapiens
gctttaggtgctgttattgcctcttccaaaaaggccaagagagacctcatagataactccttcaaccggtacacatttaatgaggatgagggggagcttccggagtggtttgtgcaagaggaaaagcagcaccggatacgacagttgcctgttggtaagaaggaggtggagcattaccggaaacgctggcgggaaatcaatgcacgtcccatcaagaaggtgggtgaggctaagggtagaaactggaaaggaagatgctttaggaacatgttttgcttttttaaaatatatatatatttataagagatcctttcccatttattttgggaagatgtttttcaaactcagagacaaggactttggtttttgtaagacaaacgatgatatgaaggccttttgtaagaaaaaataaaagatgaagtgtgaaaaaaaaaaaaaaaaaaaaa

SEQ ID NO: 3832 - DNA, 443 bp, Homo sapiens
gtaccagttctgaagaccgttttctgccacacccccacccccagctgaccagggaggcagaggacacctccccatcactcagcattcccaggagagcatggggactaggaggaagggtgtggcatggctcagtctggcccccttgattaccggcctagcccctgctcacatcacagctgtctgaagaacagtgaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctaaataaaaccaggataatggaaaaaa

SEQ ID NO: 3833 - DNA, 481 bp, Homo sapiens
ggatatgagtgcagcagacacatttctgtccgatctgccaagggatgatatctatgtgtcagatgttgaggacgacggtgatgacacatctctggatagtgacctggatccagaggagctggcaggagtcaggggacatcagggtctaagggaccaaaagcgtatgcgacttactgaagtgcaagatgataaagtggagtaggacggaggagaatccactgctggtaccactggacggaaaacggcagtacctgcaggaagaacaagccaaccttgtggttctcaaagcggcagctttgctggggatccgaaggacgatgccgatgaggccctggagatcagtccaggcccagctgttattttgagaacccggcggaagggaccggcagcagcagcagaagcagcagctgccacagacacccccttcctgtttgaagactgagatactgtctcccctgttcccttaggggcttcagtcgac

SEQ ID NO: 3834 - DNA, 440 bp, Homo sapiens
ccttgggtctacagtatgcgacttactgaagtgcaagatgataaagaggaggaggaggaggagaatccactgctggtaccactggaggaaaaggcagtactgcaggaagaacaagccaacctgtggttctcaaaggtaaggagaggccgggggcaagactgcggggagatgagtcttccttgggagaagggcagctgatgttctcctatcacagggcagctttgctgggatcgaggacgatgccgatgaggccctggagatcagtcaggcccagctgttatttgagaaccggcggaagggacggcagcagcagcagaagcagcagctgccacagacacccccttcctgtttgaagactgagataatgtctcccctgtaccaagatgaagcccctaagggaacagaggcttcttcggggacagaagctgccactggccttg

SEQ ID NO: 3835 - DNA, 336 bp, Homo sapiens
agctggcaggagtcaggggacatcagggtctaagggaccaaaagcgtatgcgacttactgaagtgcaagatgataaagaggaggaggaggtggagtgcctagaactcccgtggtggtcctgagcagagaggaggatgtcctcctgcctgcctgaaggtctcccatgaaaacactgctgaactgtgttgacactcatgaccctttttttaaaccgttaaagggaagttcggtgttggagcgatactcaatgtagtcagtctacacctggacgtgtgggccacttaagccctccccacccccatcctattcctgaataaaaccaggataatggaaaaa

SEQ ID NO: 3836 - DNA, 1220 bp, Homo sapiens
atttccaaataaaagagcatttcggaaagttttaagactctcttaaggaacagtggtgaggtgccaacgtcctcactgtccagcttcacggtgggtcctcgggaggaaggggatggaggtggtgctgcctcagtgctctgaccgggacacctggggcccagcactgctctgcgcctgcagtgctgaggatgcctctgtctcgaccccgccctccaggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgtgagtcggctctggccacaccgctgccctctgtgctccccggggagggagtccctgggtctaccacacaagggtcgcccacggccgccccagcggagctcagctgcaggccccacctgggtttcttccttctgggctctgctgtagttcccacctgtggagtattttcttctcaaatgaggacatagatgctcctaatgaaattatagatgtgaatctgggaagaatatcaaataaatacaccgagcaatagacccagggcccacatgtccttcagactgggccaggaagggccgatgtgtgcctgtgaggcagctgtgggtgggtgtgggtgggtgggctggcatacggagccctgctttcctggcaactggtcacaggggcaggagaccacctgtcggctgaggagtcctgttcctcctgggaggggaaaggccgtgttcccagtctgccatttcttttctgtgctttggtgctggagccaggcggccagccttgcccctgacacagttccctccactcacaggaagcaagactgctggtggccaaggcctacagacacaccgagaaggtgctgcaggacaacctggacaagttgcaggcggtgaggccctggccaggcgtgggggctacggcgtcacacagtgtccacacagcacccacggtccccacccctctcgtgaagtatttccaaggcacacagagtacagagaacactctgaccgatgtgaattctacccagctcaactgaaacttacgtgttccatactttttatcctgaactcgtcaagtgtgttcccccgaggtagaaagaaggctgccacagtctcctgtgcc

SEQ ID NO: 3837 - DNA, 1137 bp, Homo sapiens
tccgtgcctccgcttccctgggaaagtggcctgtcctgggtgtcctgcacacagacaggccctcacgcctcttgccacctccccaggacatagagatgctctgtctgccctggggactcacacactgctatgcctgttctttctagctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggagggaaagagccacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3838 - DNA, 549 bp, Homo sapiens
aggttcaagtgattctcttgcctcagcctcccaagtagctgggactgcaggcgcccgccatcacacctagctaatttttctatttttagtagggacggggtttcaccatattggtcgggctggtctcgaactcctgtcctcaggtcatccgcccgccttggcctcccacagcgctgggattacaggcgtgagccaccgcgcccaactcataccccggcattctttcagggactgccaaaaagagcaagatcctgtccaaggaagaacagaaagtggttgcgtttcatgagtcgggccacgccttggtgggctggatgctggagcacacggaggccgtgatgaaggtgggtcttggcaggtgccggctccacgggccttggccaaaggtgggtggggagtcccgcctgtgtctgtagctgactggggagtcccgcctgtgtctgtagctgactggggagtcccgcctgtgtctgtaggtcatgtgagaggaaagcctgccactgtcatgatccatggagcagggtgggtggcgactgatgggcgggaact

SEQ ID NO: 3839 - DNA, 1250 bp, Homo sapiens
  misc_feature (1)...(1250): n = A,T,C or G
cagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgcctttcagccaaggcctgcagcagatgatggaccatgaagcaagactgctggtggccaaggcctacagacacaccgagaaggtgctgcaggacaacctgggacaagttgcaggcgctggcaaacgcccttctggaaaaggaagtgataaactatgaggacattgaggctctcattggcccgccgccccatggncgaaagaaaatgatcgcaccgcagaggtggatcgacgccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtccgtttcccctatgcggaacggttatcagtgcttcccgagtgagcatggaacacttcgagttcccagggttatagacagtccgttcccagtgtggctgaggccacccaagaggcagcagagcattcagactccaaacagacccctgttcatgccgacgcttgcacgaccgccccagttcctgtggctccctcggaatgctaaggggatcggacatgaaaggaccctgtgagccgattgtcctatttccagcggccctgtcatccagctcatttatcaatggggnnagtaaggtccaggcaatggggttcggaggatttaccantgccccctggtggcatgnggantggtgcaagtnnnnnanttgnngttcgtgtatctacgaatgcagtttttgctatgttttggttttctttgttttgagtattgttcagatactttantaataaactgtaaagttggaa

SEQ ID NO: 3840 - DNA, 546 bp, Homo sapiens
ggcacgaggctgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgcctttcagccaaggcctgcagcagatgatggaccatgaagcaagactgctggtggccaaggctacagacacaccgagaaggtgctgcaggacaacctggacaagttgcaggcgctggcaaacgcccttctggaaaaggaagtgataaactatgaggacattgaggctctcattggcccgccgccccatgggccgaaaggaaaatgatccgcaccgcagaggtgggatccgacgcccagagggagcaaacaggacttggggcgaggaggagaccgaagagacccagcagccttccacttcggaggcgaaggagccgactttggcccaagtagttgggaggtgttggctgcacgtgcgggtggtccgggaagtgagggctcact

SEQ ID NO: 3841 - DNA, 484 bp, Homo sapiens
gatgctgcacatttgccttcctgctttgagacgctttaatgacggagacctcttagtcccacaccttcctcctcaaagcccacgcatcctgcctactgacctgggtcatcttgaccttgtgccaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggtgaggagcagcggcgcgggccctggaggtttcagagcgcttttccctgcatgactccttctgttccagtgcatgccatggggtgaatctggtgtagacgtagctttgaatttattaagtattttgtaaaagataagttgtggtcataagagagttggagctaagcaagacttcttagataatttaattggacaaaaactta

SEQ ID NO: 3842 - DNA, 395 bp, Homo sapiens
  misc_feature (1)...(395): n = A,T,C or G
tctccttccctgaggcgcaggagggcctcatgggcatcgggcggcgcctttcagccaaggcctgcagcagatgatggaccatgaagcaagactgctggtggccaaggctacagacacaccgagaaggtgctgcaggacaacctggacaagttgcaggcgctggcaaacgcccttctggaaaaggaagtgataaactatgaggacattgaggctctcattggcccgccgccccatngccgaagaaaatnatcgcaccgcagaggtggatcgacgcccagaggnagtaaacagtagtccctgcacagtgacttctgagatctgtttgattgatgaccctttttcatnattttaagtttctcttgcagaaacttnctgaacggattcctgttgtttgt

SEQ ID NO: 3843 - DNA, 4003 bp, Homo sapiens
ggcacgaggcagcactctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggaaaaaaaaaaaaaaaaaaaaaaaaaaaaaaaaaaaaaaaaaaaaaaaaaaaaaaaaaaaaaaaaggaaaaaaaaaaaaaaaa

SEQ ID NO: 3844 - DNA, 1153 bp, Homo sapiens
tcagtaagtaaactccgccacagaaaaacttagtagacaaggtgagttcccctgtgctccgtggcaaagagtgcggtgggtgacattggatcatggttaggtaatctggtaaggaaagaccccgttgtaacacatctgagcaacgagaccaaaggaagggcttgctgccacgaggcgaagtctgcttttttgaacagagagcccagcagagttgggcggcaatcgtgcccagcactgaggccgaggagaaagagagcaggagcattacattactgcaccaagagtaggaaaatatgatgcatgtttgggaccaggcaaccgaaatcccttctcagcagcgcctcccaaagccgggcaccgccttccttcggagaaggcgcagagtccccagactcgggctgagccgcacccccatctcctttctctttcctccgccgctaaacacagacgagcacgtgagcgtcgcagcccgtcccagctgtgcctcagctgaccgcctcctgattggctgagagcggcgtgggctggggtggggacttgccgcctgcgtcgctcgccattggatctcgaggaacccgcctccacctcaggtgaggcgggcttgcgggagcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagtaagcccattccctcggcccgccgccttctcccccggcgaccccgcccgcctgcccgccctgggctcctgggccggcctcggcgttaatgggattggggggggc

SEQ ID NO: 3845 - DNA, 1558 bp, Homo sapiens
ttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttgatcagcttttatgttcaaatattaataatatttgcttcaacacctccaactcataaaattgtttaccaacaatttaagcacttatgaaaattacatggtactggttatttctacatttatcttagtgccatc

SEQ ID NO: 3846 - DNA, 576 bp, Homo sapiens
tattttgtattagcattttaaaaccctaaatgtgacacagtatgcatgagtgatcatgcatctcaagaaatcttgaaatgttcctgtccataaagcagaattttttaagagaccatttcacagtctcccttcccctcactgtatcaagtgctcatttgtgaattaccaatttctcttgttttgacagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacggtgagtagttatttttgttaatcccctaaattgtgtctgttgctacaagccccatttcaactaaacattactttacggtttttgttggtaatcatttggacattacaagctaatatatgtttatagttttcttaaatgtatttgcttaaatatttttgcccccgtaat

SEQ ID NO: 3847 - DNA, 996 bp, Homo sapiens
gatctcttgacctcattatccctccaccttggcttcccaaagtgctgggattacaggcgtgagccactgagcccggcctagttaaataaaatttgataaacacgatggacttggttgtgtgttttctggtttttctgagatctagtttgaaaattctgacaactagcaaagtatatggaagcttcttcaggaaatagtaaacatatttctttttacagcctaatagtcccagtgaatattgtttttatgtggatagtgatatggtcaatgaattcaagttggaattggtagaaaaactttttgctgaagacacagaagcaaagaacccattttctactcaggtatatgaacttatttgttttatattaaatttcattaatttttagtctgaagtgactttgagtttcacttgttttttatttataaggtgtggccattgtaaaaactcatgtatttgctgttttaaaggacacagatttagacttggagatgttagctccctatatcccaatggatgatgacctccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaaggtatttatatgtaacattcaagttatagttcttttattatttttgagataaatgtatgtgatagtacatgatttttaaacttatagcaaacttt

SEQ ID NO: 3848 - DNA, 549 bp, Homo sapiens
aaaaaaaaaattaagcttttacttttaagatgataaactttagtgatcaggaaagttatcttatgtatattatattccttaatattggagaactaaagaattatgtattttctttaaaagcgctcactggatattttttttaaaaacgctatattttcatttagaatttttttcttttcagaactacagttcctgaggaagaactaaatccaaagatactagctttgcagaatgctcagagaaagcgaaaaatggaacatgatggttcactttttcaagcagtaggaattgtaagtatgagtagtaggttttgcttttctagctaatgtgctatttcgtgtgtgtgtgtgtgtgtgtgtgtgtgtgtgtgtttccacgtttcttccaaatagtaaagttatattttcagaagttatacattgggtttttttactctgtatgcactggtttttaaaaatacaaatgtttaatacatacattcttggtataaaaattccaaacaattccagtgtattttgagttaaaaagtgaagttctccccttactcca

SEQ ID NO: 3849 - DNA, 527 bp, Homo sapiens
atcatttaagtacaactttttaactaattattttcctcttcttgtgccctttttaggtgatttggatattgaagatgacatgaaagcacagatgaattgcttttatttgaaagccttggatggttttgttatggttctcacagatgatggtgacatgatttacatttctgataatgtgaacaaatacatgggattaactcaggtaaaatgcacacatattaagagctcttctatatgtttttatgattttatgatctagccctaatttttaaaaatgtgtttacagtttgaactaactggacacagtgtgtttgattttactcatccatgtgaccatgaggaaatgagagaaatgcttacacacagaaatggtaagaaaagtctgttgtttgatttaatgtgacaggtggttttacataataagatactattgctaattattaaactttgctattgtacttacccaaggcaaaatgttatttcatgtttaataaaatgtctattctttgttaaaactattattttat

SEQ ID NO: 3850 - DNA, 931 bp, Homo sapiens
  misc_feature (1)...(931): n = A,T,C or G
gatatggtcaatgaattcaagttggaattggtagaaaaactttttgctgaagacacagaagcaaagaacccattgtctactcaggacacagagtgagacttggagatggtacgtcccgatgtccgagtgggggagtgaaaacagtgacgtgcctacgggcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccagacagagcaggaaaaggagtcatagaacagacagaaaaatctcatccaagaagccctaacgtgttatctgtcgctttgagtcaaagaactacagttcctgaggaagactaaatccaaagatactagctttgcaggaatgctcagaggaaagcgaaaaatggaacatgatggttcactttttcaagcagtaggaattgggacattattacagcagccagacggtcatgcagctactacatcactttcttgggaacgtgtaaaaggggtgcaaatnttagtggaccaggattgnattgngcaaanggcaattatttttaatnccctctgnnttnggatgtaggcttctggggcaatcaattgggtgaaagtgggttccncaggtgcccagtnttggttttggaggtaatnnncttttcaaagggannnggaacctccttcagggtgagggtttcncttaggngttttggcnaaggttccttnnggttttcttaaatttnca

SEQ ID NO: 3851 - DNA, 525 bp, Homo sapiens
tgagccaagattgcgccattgcactccagcctgggcaacagagcaagactctgtcttgggtaaaaaaaaaaaaaaatccttctatactttagattgactcatattttttccccacagacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgaggtaggtgtcatgatataatcagaaagggacaactttcagattttagcattcaagaatgtatttataagtttgattcaaacactcatttgaaccacaaattacatttgtgtgtgtgtttgaa

SEQ ID NO: 3852 - DNA, 514 bp, Homo sapiens
  misc_feature (1)...(514): n = A,T,C or G
gcattacaattagaaccacatcgagagtcactgacactttctttacccatgcctcagactcaggatcagacacctagtccttccgatgtaagcactagacaaagttcacntgagcttaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccacacccggcctagtttttaattttttaaagccataggattctgttcaaatggggttctagatcgcgagcggccgct

SEQ ID NO: 3853 - DNA, 441 bp, Homo sapiens
tatagttgccctttataaaagtacattaatctagtagacaaatctccatgtaacttaattacatggcatcttctaatccttctgtgataagcagaaatgtaaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgagttattttacaagggtataaataggcctgaaaattagaagttagaagtaaatagaaattatttttagaag

SEQ ID NO: 3854 - DNA, 632 bp, Homo sapiens
aggggcaccattttcttgaaaaaggctattgattattctctaatctgacaccaacctaagtcattaaaggaattttagttactgaagattgtatattcatgaactcttcacttagctcactggcagcaaaggagttttatttagggggtttgaataaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgtttactaaaggacaaggtcaccccaggccagtacaggatgcttgccaaaagaggtggatatgtctgggttgaaactccaagcaactgtcatatataacacccaagaattctcaaccccagtgcattgtatgtgtgaattacgttgtgaggtaagtaagtttgagaaataaacatttttggggaacaaatagtaattctttttggatactctgttcatttataggaagataagataataaatattaactaaattttaattcttttacatcgctaccaaattattattttct

SEQ ID NO: 3855 - DNA, 423 bp, Homo sapiens
tcagatctcttgggtgtgctggagtgagtaaaaggggaatgaattactgtgttcatgctgagacttaattgaacgggtattcagttgatctaggtgatgggcactttgttacttttattgtaacaaatttgtatatttagttgctttaaaactttatttcatgctttcattaggccttgtgaaaaagggtaaagaacaaaacacacagcgaagcttttttctcagaatgaagtgtaccctaactagccgaggaagaactatgaacataaagtctgcaacatggaaggtaagtgaaaattatttgtgattgattatacactttatttatacatagacattgtagtattaagataactttagaattgtgagggaaggtttacagttccatggtgtttggttatgtaacatttatatcttcaactc

SEQ ID NO: 3856 - DNA, 443 bp, Homo sapiens
  misc_feature (1)...(443): n = A,T,C or G
aaaacgtgnattaaatccactcgtgnacagttaaattttatccaaagcttactggcccatgtccgaactncaactacttatctctgctttttttttccctagccattgtaaaatattttttttaactgctttgttcttcatacacaggtattgcactgcacaggccacattcacgtatatgataccaacagtaaccaacctcagtgtggctagaaagaaaccacctatgacctgcttggtgctgatttgtgaacccattcctcacccatcaaatattgaaattcctttagatagcaagactttcctcagtcgacacagcctggatatgaaattttcttattgtgatgaaaggtaaattagatctaaaatgtgaatttgaaatttttaattagtctacagcattactgaatattcaccatagcaaagattcagcgctggccatg

SEQ ID NO: 3857 - DNA, 392 bp, Homo sapiens
aaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctggttagtttattctttttgaccttgaacatcacaaagacaaaatacatgaaacatttttatttaggagctttaatctaagtgagaatgactttggttccttagcaagattaaaaagtaaagttgtggct

SEQ ID NO: 3858 - DNA, 359 bp, Homo sapiens
gcagctgtaaacaagaaaaaaaaaatcatgcattcttagcaaaattgcctagtatgttaatttgctcaaaatacaatgtttgattttatgcactttgtcgctattaacatcctttttttcatgtagatttctaaaattactcaattattgaaatctacatgaaaaaaaggatgttaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttaaa

SEQ ID NO: 3859 - DNA, 357 bp, Homo sapiens
  misc_feature (1)...(357): n = A,T,C or G
aaacttaagaaggaacctgatgctttaactttgctggccccagccgctggaganacaatcatatctttagattttggcagcaacgacacagaaactgatgaccagcaacttgaggaagtaccattatataatgatgtaatgctcccctcacccaacgnaaaattacagaatataaatttggcaatgtctccattacccaccgntgaaacgccaaagccacttcgaagtagtgctgaccctgcactcaatcaagaagttgcattaaaattagaaccaaatccagagtcactggaactttcttttaccatgcccctttggtttgctgtcttgatggtggtggttgtgataaactttgaa

SEQ ID NO: 3860 - DNA, 250 bp, Homo sapiens
ctatcagttaacttgggaggagaaaaatttttctttatcagtgtctccctttttttcttaaatcttgtattttttactaacagaattaccgaattgatgggatatgagccagaagaacttttaggccgctcaatttatgaatattatcatgctttggactctgatcatctgaccaaaactcatcatgatagtaagtacaatggaagaactcagagatattctaattacttaactgttgcaacctctgtac

SEQ ID NO: 3861 - DNA, 2939 bp, Homo sapiens
cggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggacctggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattatgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaaaaaaaaaaaaaaaaaaaaaaaaaaaaaaaaaaaaaaaaaaaaaaaaaaaaaaaaaaaaaaaaaaaaaaaa

SEQ ID NO: 3862 - DNA, 540 bp, Homo sapiens
aaaaaaaaaatcattttaacatacaggcccctcctttccatgatgaatgcattgggggtaggcgagtagggaagatgatacagatacatttgaacaacagacaccatgctgtagtaaggattgctcctaccctgccactctgacatacatagccttatttgcctgtttccttaagttgaaatcatctcatatatacatatgtatgtgtgtgggggggtgtgtgtgtgtgcgcgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacatttttttttagcaataaaattgagtgtcaactatttaaaaatcgcagcgagggagctgctctgctacgtacgaaaccccgacccagaagcaggtcgtctacgaatggtttagcgccaggttccccacgaacgtgcgg

SEQ ID NO: 3863 - DNA, 560 bp, Homo sapiens
cgtctgggcgcctgggcgctgctctttttcctggtcaccacgctgctggcgtcggcgctcggagtgggcttggcgctggctctgcagccgggcgccgcctcccccgccatcaacgcctccgtgggacccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagttgtggggggatgtgtgtgtgcacgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaaa

SEQ ID NO: 3864 - DNA, 437 bp, Homo sapiens
tgagaaggaatcagtcatgtaaacccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtcccaccctgtccccagatcccctattccctccacaataacagaaacactcccagggactctggggagaggctgaggacaaatacctgctgtcactccagaggacattttttttagcaataaaattgagtgtcaactaaaaaa

SEQ ID NO: 3865 - DNA, 510 bp, Homo sapiens
gttgggattggggtgtcgggggcccagggtgccctggcctttggccccgagcgccttaacgcctttttgtctccccgggagagttgctgctgcgtttgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggctgaggacaaatacctgctgtcactccagaggacattttttttagcaataaaattgagtgtcaactaaaaaaaaaa

SEQ ID NO: 3866 - DNA, 323 bp, Homo sapiens
  misc_feature (1)...(323): n = A,T,C or G
taaactcactaagggaaaagagatgataagattagtagcatcagagagatcagtggcagaataagggactgggatatattaatgtgaatggcaactcgtatgtgtgtatgtgtatgtgtgtgtgtatgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgatgtcactccagaggacattttttttagcaataanntagggtgtcaactattt

SEQ ID NO: 3867 - DNA, 250 bp, Homo sapiens
  misc_feature (1)...(250): n = A,T,C or G
cacgcnattattctcctccacgcacttcatcatcagcngcagcgtngnnnaactggaagagttcccaaaaggcagntggccagcggcgtcacgatgccccacaggaagcggtaggggtttttgcccgccttggcaagtacattctgtgctgcctgctgggtcacgccatccatgggctcctggtactgcccctcatctacttcctcttcacccgcaaaaacccctaccgcttcctgtggggcatcgtgac

SEQ ID NO: 3868 - DNA, 211 bp, Homo sapiens
  misc_feature (1)...(211): n = A,T,C or G
aggagatctgggatncccggctgcctggagtacntgtgttcncaagggttactcctcaaaacccccagttctcactcatgtccccaactcaaggctagaaaacngcaagatggagaaataatgttacaacnccatgctggttattttggcggctgtagttgtggggggatgtgtgtgtgcacgtgtgtgtgtgtgtgtgtgtgtgtgtgtt

SEQ ID NO: 3869 - DNA, 489 bp, Homo sapiens
  misc_feature (1)...(489): n = A,T,C or G
cccagggaaccctgaccacgcccaactggcccgagtccgattaccccccgggcatcagctgttcctggcacatcatcgcgcccccggaccagctccatctcctccgaaggaatgaactcctcgtccagttcgtctcagatctcagtgtcaccgctgatggcttctcagcctcctacaagaccctgccgcggggcactgccaaagaagggcaagggcccgnccccaaacggggaactgagcctaaagtcaagctgccccccaagtcccaacctccggagaaaacagaggactgggacctgccttctccacccttggtgcctccctgaagttttacgtgctttgcaagcagttgcccccccatgaagaaaggagtcagttattttgttgatggggccaggtagaaggagaacagagggccccttnttttntttcagagagttttttnggtttttcaacgggcccaacaggggncagattntttangcatgn

SEQ ID NO: 3870 - DNA, 332 bp, Homo sapiens
  misc_feature (1)...(332): n = A,T,C or G
ctccagccgagcttcccagaacatcacatatcactgcaaaaatagcattgcacgaaacacactggggaatggagcaaaacagtctttgantatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttttttccaaaatgtttgggaaacag

SEQ ID NO: 3871 - DNA, 253 bp, Homo sapiens
  misc_feature (1)...(253): n = A,T,C or G
atttttctaaaggtgctatttaacatgggaggagagcgtgtncggctccagcccagcccgctgctcactttccaccctctctccacctgcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgaccc

SEQ ID NO: 3872 - DNA, 7150 bp, Homo sapiens
caatgtgtgttaagtcacttgtttatttctcaagatgtgcacactcaagtatgaagctggccgggacaactcatggctcctaggtatgtacaggccctttgatggcttgggttacagacaacctcatagctggtgcaccacacacacgagataaaacaggaagcctaaaaaccccaagccacaccaagaaaaatgagagaggggagggcggggtaacaatgcagcatcccgcggagggaacttaatgcacaaggagggagaacagagggtggaaggcaagccagcttcgtcttcgccgccgcagctgctgtgtggtggtcaggggactgagttcaacaggtccttcaggaagctctctggatcggtgatttctgataaaagaccggccacatcgaggaactctgagaaggtctccactggcatgaactcctcctggaaggttttcagggctttgtcggcagcttcgtagatgggcatgtcgttgtggcggatgtactcagcgagagagcaggaccagcctccctctgtgttactggtaggcaccttcttaaacatgttgtaaatgagatcgacgagggcccaaaagagaagggaagaacggtaagcggaatagtccttcactgccttatctgtcagcctggtggctccacctggagccactgcccgagcctgcgaggtcaccaacagcctccgcaagatttccacacgtgtggctctccactgctcagggggcaggatgtgaagggccaagactgtgaaatagtagggcccgtccacttcaaaggcactctccacccacttctccttgggctgttccagaaagccttggaggttcttctcttctcgggaagttgctcgggttgtgttcaggacgtaaagcacagtgtgaatgatgtacgggatcaggtggatgttgctctcccggccgcccccgccagtgtctgcgctgaacgactgctccatggcgaagcgcaggaagagcagtttgatgtcatggatgttgagctgatacgtgggctcccgctggcctgtacattcctggaggtaagtgttgtgtcttgccaagcaagtggcaaaagctgattcagggacatgaggtccccagaccggaaggagcccgttgcacttggtgttggcattctgcagggcggcactctcccactcttcccggcctcgagccaacctgacggcagccagatggcagtcgtagtgcacaatgttgaagtgggacacggtgctgtagccctgctgtttccggggcttattctccatctcctccaaggctacccgcttcgtgaaggtataaatgcccaggacctttgtgggctggaacttgtatccctccctgcagatgcagcacgtgaggccaggctcctcgatcagctcttccatctgcttcaggagtgctgtcttggtcacgacctggcccttttcatttgtcgtcatgcccagggtgcccagggccttctgcctcattgccatggccatgcgcttcttctctgcccgggtctccctgcgggctgcgtcaatcttcttgtttacgtcagggtgttcccgcagggcttccagcaggttctctgccaaggtcccaatgccctcatcactggacacctgctccagcttatgcaggttcgggatggaatcagttccaatcagaacctgggtgccagggtgctggatggccaggccccgaagcagccttaggataaatggcaaggctgggcgagacaaaaactttttccagatgtcggcatccaaattcttggcgctagggatgtgctttttcatgtagtcaagtgcattctgggtgatccccttctggagaatcagatccttcagctggtgcccattgctgttgttcttgatgccagcagctattttacagaagcagtccaggaagactttatcatcaccactgtgatcttcatcatatttatcaaagttgcagtatggtttgaatcgctccaccaagatctgcattttctccacctctccaaaggaaaggtacgggatgatgcgaagcaggccctggagcacactggggttggagcgaacaaaggtgctgttgatctggtccaagagcatcaccagttgatccttgtcacctgtcaggaggaggttgcccttgtcctcactcaggggctcagcattggactcatctagaatgatctccatgatgctaagcacctgctcagccacagctgcacccccactgtccttgctttcttgttcagctacaagggccaggtttagggtccccagcatgacgttcaaggtgttcatttccagtttgaccagttgctgccggttgactttcaccttcacgcagtaactgaacaatttcagtagcactgttagaaggtggcgtccctgcttgaaatctctgatccctgcgagtctgttaagcatgcattccaggcccccacactgggccatcacaccagccattttatacacttcttcttcatcttcttcttcatctgtagtagagtccagggactcaatgaactcctctgtggcatcgcccagcagcccccgcatacgataaacaatcctcatgggctctccctcattcgtggtacaccagactttcttgtaaacttcagccacaggaaggtccaaactaatgattttattgttcactagaagctccatgccactgtcatcttccaggagggccactaagtcacagtcctggcaaatcttgttctttatatccctcatcagcggcccgatgcctggctcattgctgctatacgggttcccaggcatcctgccctgtaagaagtcttcttgttggggatccttctccagggtcacaaagaactcagtgacttcattctcctcaggataaatgatgctgcagagcctctcgaagatgaacaccggggtccggtagtcatccagattgtagcgcttggctgtctcaatgcacacagccatgaaggccttggtttctgattctgtacctgtggtcatgtcctccagcatctccagcagcatgtcctgcgtctcatcgatcagcttggtcctctgcaccaccagcttccgcaagcacaggtatccattcagcacagtacccaccaagcgacttttaaaatgtcttttgatggattccacctcaacaaaggaggagagaaggcctgtgagacttttaagggcataaccctgctgcagatcggtactcagggtagcctcctccagggccagcagacgagctatttccttggtgatgaggttgcccacatagggtaggactccccgagctgccaagtagactttccagtgcgcagaagtgatgagcttctggtagagagccaggtactcagctgcacactccccagctatgctcagctcatccaggtaactggtaagcaggtccaggacctgctgcttgcggctgggaatggtggctagagcttccacaatggtacaggctgcctgccgtgcggcctgcgttgctggagtgaaaagcacttgtcgcagccagttgttatgccccagtttgagatccaagggggaggtcctcttcccccgacgactcaggaactgtttccacctccacacatacttctcagtcaaatagagatggcggagctctgatttgctgggggctttcccattgccatctatccctctgataggaagacacttcttccaggcatcataggatgccttggggtctctcttgagccacagttgagcctgggcatggatctcattgcagtatggcttcaccgtggtgagggcctcaacggggacatccttgttcttcttgctagtgggagcaggtggttttatcagcttctgcaagatcctcaggcacatgagggtaatgttttcaaccaccacaggagtcttaatgttcacagccatgaggaaaaggctgagagcacagcgtaaccggagctcccagcagctgtcctccttggagatagaatccgtcagcagcagcatttcatactgcaggctacttgccagatcggggttggcccagtggcccttcagggctgtggagaccttgccaataatcaggtcattcatctgttgggtggcttctgggttgtctcgagttaggaggcacatgagctggcggacctcctcccgcatggccgcagcccctcggcgaagattataatcaaagagctcccggataaggccctgggagacaaggatgtgcctcaaggctgggttggtggccagggcccgaagtagtgtgatacaatgttctgtgacagccgaggcgcagccatagcacttggtggaggatgtgtggccacagcccaggacggataaggcacggtactggctggcagtgaatgtgggctgcacggaggtccgggatgatttagtggctgcttccctctgctgtaggtcatattccaacaactctttgcgcgaagcaaagactttctggatgattttggagagttcatcaaaagagttcttgcagtctccacaatactcctgagccaactgcaggatgtaacgattcacactggcagaagtggagctgatgccccctgctgttcctgagtcatcctgtggcttttctggagctgcctcattcactttgcagagcaggttctccagctgtggccggtgtcccatcagctgatgatacactcgatcagctttgtccaaaagtgtattgatgttggatacagccttcttccggtcttcttcattctcaatgggatccactgcacagcaaggcttggcatagagcatgaagtcgaagcgggcatatttacagaagccacaggcattgcagaggaagggatccttttcatcgtagttgatggatctgcatttgtgacactggtacacattctctccacagttgccacagactcctgggttggcagggaccgaggcactacagcgagggcactgcagggtctctgtggaggcctggtagttttcatagaagtctgcaaactcaatcatcagattggaggccacaatgggcaacggcaggtcaatcttcacctctgtctgtccaggggtcagctgaaccttcttggctttgtgccagcgagctggcttgtttttcaactccacgatggcctgcacggttcggttgttataatacaggttgatggtccgcaccatcttggtccgtttcagatccccgattttcactgtcactttgctgatggtgtgactgccaatgagcttcacaacctgctgggtggtggtgtaccgcgtgtccactttaatggaagacagcttgatataacagaacggtacttccgggttattacacaccaggcagggatcgctctccaggtaatagccatcaaactccactaagccagacaaagtgttataaatgttcgagttggggtggttggtaagaatatggttttgagtccgcagaatctccacagccttctgtgaatactccttcaacttcttctctgtttgtggagttttcagggagaaatatcctagtaggtccacaaactgggcagccttacgaccataggctgggagttctggccagatggaccacatcagatctagcaggagctcctgttgagatttgctggaatttctgtagatgtgcagtgtcagacagtgggcctgccagcgcaccgaggaagaattggactctaacaggaaacaacgcaggaactggatcagggtttccttatcggcaaatttgttcagctggttcaccagagctgtgcacagctggtcctcctggctgccagaggtctcaccatctttctccttttctttttcttctttcttgctctttttagtggaagacttggactgtgttgtggcttgtccagaactggcagccacaggggctgaggaggaagaagcactggaggatcccgaagaggctgccagtgcagcgagcaccttgctgccgcacagagcacaggagagcagttgcagcagcactggggacacgccctcatccacaaggaaactgacttggaggaggaagtacaggacggagtcatctttgatgcagaatttctgccagttgatggttcgctgggcggcaatctctgcacaggctttcaggtgctccatcaggctgatgagtgtgtcatattgcaaggcggagcctgagctggctgtaaccacacttgcccggaggaatatcccctgctcttctagcagcttcttgatcccacgcacgtgagagtccagggtgtgcaaatcccggagctggcggtacttctctttggatccacagatgaagagcagaagtttgcggacttgacggcgcacaaatggagtctgctggatcatgaggtactcggagagaaagtaaaaccacgagtggtcaaagacaggaggtgggattcgagaattggtgtcagtaatctttttgatttggtaaggaagcctcagtaccatttctgttagaagctgagtataggcctcaaacacatcagcagcatgacccttcacatactggcggagaaagaatgggctcatgtcaggtggggaggaggtagtatgtggtttcagcaactggctggtagccacaggctcctcgtcattctgttggctcttccaatattccagcagtgatttgagcacgtgcaggcagtagtccacagccccagagctcagtagagctgctgctgtggcactggagatgagggaagatgactcacatatggaagacttggatccagatttggtgcgggacatgaagacactcaggagtctcattactaccagatggacttcattcagggcgctgcgctcattcttcttggagacatcctttttatccatacccaactcagcaataagctgggagagcaggttgtctagggcccccttgtctttctcatcttctccatccagatctgtagtgagcattagaatgacctgcatgtatgggatggcccggacaccgccaacgtttcgtaattgaggcagggtctgcagtaatctctccaacagcattagacggaccatgtgcagcctgttgctagtgtggacatctccttcagtttctccttctccttctccctcggagccatctccctcctggtgcccagtggtggtgctgatggctccagtgcttgagctgacacttcctggtccagccggatgcccctcagctgtagcatcgccataagcactgctccggccagatacactgtgctcg

SEQ ID NO: 3873 - DNA, 346 bp, Homo sapiens
  misc_feature (1)...(346): n = A,T,C or G
caaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtccaaagggtgacaagggtgaaccaggcggtccaggtgctgatggtgtcccagggaaagatgtgcccaaggggtcctacttggtcctattngtcctcctnggccagntggccagncttggagataagggtgaaggtgggtgccccggactttcaggtatag

SEQ ID NO: 3874 - DNA, 268 bp, Homo sapiens
aagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggccctcctgggattaatggtagtcctggtggtaaaggcgaaatgggtcccgctggcattcctggagctcctggactgatgggagcccggggtcctccaggaccagccggtgctaatggt

SEQ ID NO: 3875 - DNA, 324 bp, Homo sapiens
tttgtgttaagtcacttgtttatttctcaagatgtgcacactcaagtatgaagctggccgggacaactcatggctcctaggtatgtacaggccctttgatggcttgggttacagacaacctcatagctggtgcaccacacacacgagagaggggagtgcggggtaacaatgcagcatcccgcggagggaacttaatgcacaaggagggagaacagagggtggaatgcaagccagcttcgtcttcgccgccgcagctgctgtgtggtggtcaggggactgagttcaacaggtccttcaggaagctctctggatcggtgatttctg

SEQ ID NO: 3876 - DNA, 287 bp, Homo sapiens
  misc_feature (1)...(287): n = A,T,C or G
aaaagtgtaatgcaagantttaaagaaatattttnaaagccacaattattttaatattggatatcaactgcttgtaaaggtgctcctntttttctttgtcattgctggtcaagattactaatatttgggaaggctttaaagacgcatgttatggtgctaatgtactttcacttttaaactctagatcagaattgtcaacaataaaaaccaaattatggggctgcttttgtcacactagcatagagaatgtgttgaaatttaactttgtaagcttgtatgtgggttgt

SEQ ID NO: 3877 - DNA, 241 bp, Homo sapiens
caatggtgctataataaataaacttcaacactctttatgataacaacactgtgttatattaaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctttctggggactcatagaatac

SEQ ID NO: 3878 - DNA, 632 bp, Homo sapiens
  misc_feature (1)...(632): n = A,T,C or G
gactgtcaatgtacagatgttacttacacagacgggtacttccgggttattacacaccaggcagggatcgctctccaggtaatagccatcaaactccactaagccagacanagtgctaaggaagaaaccagtcttagcatgaacacattttcatcttaggaagcactgagtttcacaaaanaatcatgacaaagccatggctcaatgtgagccaaagtgagcccaaagtgagccccaccctagtgagaactcaaggacacaggagaaatcccaatagggttacgaagccacaggaaagaaatttcaactaactgaccttagatgtttcctaatctttgatctatccttcagaggaattctaaaaagtagtaaaatttgactcaagagtcacaattaaatttactaaaaatcattgaactgtacatttaaaataggttaatacataaattatctcaataaagtttttttaaattttttttaaagaacagtcactactaaaccagagaaataataaactgtcaatttaaccaatatcctcttttagaagtttttttaaaaaaaggaagacattttctttaaatttgtttcaccttatttaacttaaacccttgaaactaaagaccttttttttt

SEQ ID NO: 3879 - DNA, 300 bp, Homo sapiens
ccatgctggagcgtggtggctcaatcaggtcactgtagtgtgatacaatgttctgtgacagccgaggcgcacatagcacttggtggaggatgtgtggccacagccaggacggataaggcacggtactggctggcagtgaatgtgggctgcacggaggtccgggatgatttagtggctgcttccctctgctgtaggtcatattccaacaactctttgcgcgacgaagactttctggatgattttggagagtcatcaaagagtcttgcagtctcacaatactcctgagccactgcaggatgt

SEQ ID NO: 3880 - DNA, 848 bp, Homo sapiens
  misc_feature (1)...(848): n = A,T,C or G
angaagtaggcgccacagcacaggtctccccaaacaccaatttttcagttcaccccagagaaaaacagcaccctcgaaaaagctgcgcccccaagattctggcaatccgcggcttacaatctctgagtctgcatctcagttatgccatagtatatgcaatcagcgactattgtgacaactccgagattcctgttgtacactctatccacgactagagccagtgtcaatcccgactgcgtactctttgatccacagtgagacagagttgcgacttacgccacaaatgagtctctggatcatgagtactcgagagaagtaaaccacgagtgtcaaagacaggagtcggattcgagaattcgtgtcagtaatctttttgatntggtaaggaagcctcagtaccatttctgttagaagctgagtataggcctcaaacacatcagcagcatgacccttgggaaatgtgcaggctggcagggctgcgtgtagggtgttataggtgacaaagctagagtcaagcaggtggctgggtcctccagaactctttggccttcacatactggcggagaaagaatgggctcatgtcaggtggggaggaggtagtatgtggtttcagcaactggctggtaccacaggctcctcgtcattctgttggctcttccaatattccagcagtgatttgagcacgtgcaggcagtagtccacagccccagagctcagtagagctgctgctgtggcactggagatgagggaagatgactcacatatggaagacttggatccagatttggtgcgggacatgaagacactcaggagtctcattactaccagatggactcgcgtgccgaatt

SEQ ID NO: 3881 - DNA, 588 bp, Homo sapiens
tttctgattctgtacctgtggtcatgtcctccagcatctccagcagcatgtcctgcgtctcatcgatcagcttggtcctctgcaccaccagcttagctccggtccagcgactcttaactattaatacaatttctggtcctaggtggctccaacagagacaaaggacagacggagacccttgtgctccaggctcttccctgggaaaaccattctggggtaatgttctgctccttccctcctcagtcaccgcaggacctgggaggggaagctgagaaacacaaggcatgtgaggggaagtcagagaggacagctgggcctgctaggccggctcaccagatcggggttggcccagtggcccttcagggctgtggagaccttgccaataatcaggtcattcatctgttgggtggcttctgggttgtctcgagttaggaggcacatgagctggcggacctcctcccgcatggccgcagcccctcggcgaagattataatcaaagagctcccggataaggccctgggagacaaggatgtgcctcaaggctgggttggtggccagggcccgaagtagtgtgatacaatgttctgt

SEQ ID NO: 3882 - DNA, 2070 bp, Homo sapiens
gccactgcactccagcctgggtgacagagtgagattccatcttaaaaaaacaaaaagaaaagaaataacattttaccagctatctgggtgtcccttagctcagccacattgacacataaaatgaaccatcacactgcataattctctcaaagtcatggggtcagaggcctgactcatatggtaggtcctggtagtaaatcactggagcaagtgcgtttcaagggctctcagattggcttgcacatgataccactgggtggagatttggagaagaccagtgagtctctgagtttaacgtatcttatctgtaaagtaggggaagtgatatttcctcaacagcattgatgtaaagattaaacacttaacatagtgtttcacagttagtaaatgtgcagtaaatggggtgattgcaatgagaaaacactccaaatgtgcgttgtccccaaaattagggaggaagaggaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcaggtaaggcagcccttgtgagacagaagagccacccagctgtggcgctcacccctgtcctaccgctccagcctcccgccctggctgcttcctcctgccccttccccaagccgaggcggggggaacagccgcctgcgctctcttgggaccctagatttgggggaggaggtaacgagaggcggagagggtggctcctcaaatatacacccctcctgtcctccgccaccccacctttgatttctcttccctcaacccagcactccagccccaccccagggtcaatttttgcccccttccatctgagcagtgttaccaggccccagggggacctggagatctgggggccggcgtgggtggggtcccatggagtactccagcacacgcaggtgagacccgggatcgtggggtgggacatgtgggatcccccagaaccgagtctgagggacccaggacaggagaaggcctatggtgatttgcattcttcctgccctggctccatcctcaggggctccctgcagacagggggggccttcgccctggaagcctggacgccgagatagacttgctgagcagcacgctggccgagctgaatgggggtcggggtcatgcgtcacggcgaccagaccgacaggtgactctgcccctcctccccgtcagcaccctgcccccttctctggactctcagacccagcctgatcgatcccccatgtgtgtaatgtgcaccccagcatggaggaagcgtggctgcaagtaccaacatgtcagccacttgaggacgggaccttgtcaaatgcaaaaagcctgtgcttccccacagccagggtcatttccacaaatgtgggtcttggagtggggtccttgcttacgacttctggcctgcgtttctcctcaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcttctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgagccctggggaactgggatttcaggccctacagacaatgggacaccgactgggtggggtggctggtggtgttttagggggcttttttgttttttgagacagagttttgctccc

SEQ ID NO: 3883 - DNA, 492 bp, Homo sapiens
cttgctctttttagtggaagacttggactgtgttgtggcttgtccagaactggcagccacaggggctggggaggaagaagcactggaggatcccgaagaggctgccagtgcacggagcaccttgctgccgcagagagcacaggagagcagttgcagcagcactggggacacgccctcatccacaaggaaactgacttggaggaggaagtacaggacggagtcatctttgatgcagaatttctgccagttgatggttcgctgggcggacaatctctgcacaggctttcaggtgctccatcaggctgatgagtgtgtcatattgcaaggcggctgatgtctgtgctgtaaccacacttgcccggaggaatatcccctgctcttctagcagcttcttgatcccacgcacgtgaagagtccagggtgtgcaaatcccggagctggcggtacttctcttggattccacagatgaagagcagaagtttgcggacttga

SEQ ID NO: 3884 - DNA, 502 bp, Homo sapiens
gttaaccattcactccccaggatcctctgggctctgagctgtttcttgactggtgctcccaaggcccattcccctcattgcagatgctcttcctttgtccagctagattgccacagtccaagcaggccattgaccgtttccatacagcagtcacctgtatggaacccccatgggtgtgccggtgccgagccaggcctgcctggaggctctgctcctgatcgttccctggggcgcctgtggtgtttcccaggaggaagaggagagccctgcagaggggagcaaggacgagcctggggagcaggtggagctcaaggaggaagctgaggccccagtggaggatggctctcagcccccacccccacctcttctgtatgtttgaattctttcagtagctgttgatgctggttggacaggtttgagtcaaattgtactttgctccattgttaattgagaaactgtttcaataaaatattcttttctacaaaaaaaaaaaaaacaaaaa

SEQ ID NO: 3885 - DNA, 598 bp, Homo sapiens
ctaccccattgtcatcttcatccactacaagagcgccaagcacatcaaggagcagagagaccccatctacctgagggacaaggtgactcagaggcattccaaagagcagtttgaggcggcgcagaagcttgagcaggagtacagcaggtacttcacaggtaggtgtgcgtgggcctggagtggggagcaggcagcagggaaggaagcagaggcttcctaaggctgttttcttagccgtggagaagcccgcgctttctacatgctcccaagtgctgtcatgagcacgttcctgacaagtcaggtgttcagattgcagtccctggccaacgtcaggattcttacaggttgaatgttaagctcaccgatcttggcctcaggtcctgcctggcttgcctgctcattttcacacggtgcagtggtgggtctgtctcatagcacaggtgcagtttagtgcagccacagtgtccccaggcagggcggggactggagcagcccccagtgtgccagcagtgtgggcagcggaggctaggggcccatctgtccctagcaccctccagggcagtcccgttttgcagcgggatttggcaaacccccctcc

SEQ ID NO: 3886 - DNA, 438 bp, Homo sapiens
ccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagt

SEQ ID NO: 3887 - DNA, 590 bp, Homo sapiens
aagtacagtggtgtgctgagctccattgggaagattttcaaagaggaagggctgctgggattcttcgttggattaatccctcacctcctgggcgatgtggttttcttgtggggctgtaacctgctggcccacttcatcaatgcctacctggtggatgacagcgtgagtgacaccccagggggcatcgggaaacgaccagaatccaggttcccagttcagccaggccctggcactccggagctataccaagttcgtgatggggattgcagtgggcatgctgacctaccccttcctgctagttggcgacctcatggctgtgaacaactgcgggctgcaagctggggttccccccttactccccagtgttcaaatcctggattcactgctggaagtacctgagtgtgcagggccaagctcttccgaggctccagcctgcttttccgccgggtgtcatcaggatcatgctttgccctgggagtaacctgaatcatcttaaaaaaacacggtcttcaacctggccaccgtgggtgaaggcctgaccaccttgggacaactgcaagacgatttcaacccaacaacaaccagatgtg

SEQ ID NO: 3888 - DNA, 13959 bp, Homo sapiens
gggccctggtattacagcatcaggagctagagtaggaccgagcccctgattcccaccttccaggtgcccctgagccagcctccagaggatgagctggataggctgacgaagaagctggttcacgacatgaaccacccgcccagcggggagtactttggtgagctgaggctgtggggtgggtgggacgtgggaagggaggctgggagacagaggggacagtggcttcctgggtctgtgaagatgtgatgctgtttgctcccctgtcctcaggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggtgagtggctggggctgggaggagggagtcagtggctggatgcagggggcttccatccaaggtggtaactagagcgtccaagaccaaaggaggaacggtgctaaaagccaggcgacttgaaagtgatgtacaaacagggcggaattctgcaagtatcaagcaagtagcttaacactggtggctgaagggaaggacgcagctcttaccaagttttggagcatctttacaatttaaagagaatgtgttagattcccatgacacccctgtgaggcaggtattactactgattcctggttttgttttttgtttttttttgagacagtctcgctctgttgcgcagactggagtgcagtggggtgatctctgctcactgcaacctcagcctgccctggttcaagcgattctcatgcctcaggctcccgagcagttgggattacaggtgcccaccaccacacccagctaattttttgtatttttagtagagacagggtttcgccatgttggccaggctgttttgaaactcctggcctcaagcagtccgcccactctggcctcccaaagtgctggcattacaggcgtgagccaccgctccctgccctgtatttgtttttttaatagcacttatagtgatacatgacctcctattttattgtttctctctcctccagtagaatgttttttccttttcacaagagcagggactttgtttagttttctgttgtatctttaggacttatgacagtgcctaccatttggaatgaacaaatgaatgagtgactaggatgaactttgagcagagatctgactggatttaggaagtgaaccatgagatatgtctatgggagagaattctggatagaggaaatagcaaaggcctaaaacagaagtgtactagaaatgggcaacaaggccgggtgcggtggttcacccctgtaattccagcactttgggaggccgaggcgggcagatcacaaggtcaggaattcgagaccagcctgaccaacatggtgaaaccccgtctctactaaaaatacaaaattacccgggcgtggtggcacatgcctgtagtcccacctactcgggaggctgaggcaggagaatcgcttgaatctgggaggcggaggttgcagggagccgagatatcgccactgcactgcagtccagccagatcatgccactgtgctccagcctgggtgacagagcgagactccatctcaaaaaaaaaaaaaaaaaaaaagaaatgggcaacaaactgaagttgccaatgtgactggaacagatgatacataggagataatagacatgaagctacgaggcaggagagagaatgcagatgatatagggccttgaacccttggtaagacttaggaaactacaggaaagttttgagtaaaggagggacaagatgtgacataatcggccgggcatggtggctcacgcctgcaatcccagcactttgggaggccaaggggtgtgcatcacctgagattgggagttcgagagcagcatgaccaacatggagaaaccccatctctactaaaaatacaaaattagctgggtgtggtggtgcgcacctgtaattccagctaatcgggaggctgaggcaggagaatcatttgaacccaggaggcggagtttgcagtgagccgagattgcgccattgcaccccagcctgggcaacaagagtgaaactccgtctcaaaaaaaaaaaaaaaaaaaaaaaaaaaaaaaagggtgtgacatattttcttttcttttttattttatgttatttttttcagacggagtctcactctgttgcccaggctgaagtgcagtggcacaatctcagctcactgcaatctccacctcttgagttcaagcaattcttttgcctcagcctcctgagtaacaggtgcccgccaccacgcccagctaatttttttgtatttttagtagagacggggtttcaccatgttggccaggctggtctcaaactcctgacctcaagtaatctgcctgccttggcgtctcaaagtgctgggattacaggcatgagccaccgcgccccgccaagacatgacatcttttctttttacttttttagagacagagtcttactcttttgcccaggctggagtacagtggtgtgatcatagctcactgcagcctcagagtcctgggctcaagcaagcctcccacatcagcctcctgagtagctgggaccacagatgagtaccaccatgcccagctaattattttttgtaaagacagaatctggccatgttgcccagactgatctcaaacttctgacctcaagtgatcctcccaccttagcctctcaaagtgctgggattacaggcatcagccactgcacctggcctgtgacttacattcttttttttttttttgagacagggtctcactgtgttcccccaggtggagtacagtggcatagtcacagctcacctcagtcttacctccccgggatcaagcgatcctcacacctcaacctgagtagctgggactacaggtgtgcaccaccacgcctggctaatttttgtatttttttttgtggagagggggttttgccatgttgcccaggctggtcttaaactcttggcctcagcaatcctcctgactcagcctcccatagtgctgggattacagctgtgagcagccacccctggccacattcttaaacgattattctgtatagtaaatatgtgttgagttaattaattaatgaaaagaaatcctcaagatggaccccaataccataagcatggagatctgacccattcctcattaagaaacatttatttggataagaagagaggcctgagggctaggggccggggctggcctgcgtctcagtcctgggacgcagcagcccgcacaggttgagaggggcacttcctcttgcttaggttggtgaggatctggtcctggttgggccggtggagaaccacaaagctctctggaggaaggacggggcctctgttctcttctacctggcccatcagcagataactgactcctggaagaagggagggtaggggttgagatctcttattcttgagacctgtcagcaggtctcaagattccacaccttgatcatttctgtgtggcttagcttgacccatccccatttccccacatctctgttacctttcttcatgggggggcactgcttgcaaggcacgtaaaacttcagggaggcaccagtgggtggagaaggcaggtccagtcctccagttttataagcaccaataagactgacagtcacggcaaggccctcccctggctcccgaaccatggacttcactgtcgcagtcaccactgtgggagaatgggagtgagagatgaggagatgggaggttccagatggcaggactggaaacagaagcaggaggtggttcgaggagctggaatggggttgggggtattcttaccaaggctgctggcacagaagttgctctgcaaggtgcctgtccggcggcactgctttgggcaggtgggtgcatctaggagggaggagggtggagggtgacctgctcagcaggtaggagggagcactgtccccataacagcctcattgacttgaactgttcagagctctgtcaggcttccggtcctagcacccagtaggggtcatcggcaggaaggaggcaccagtgagtaccagatgaatcaatgagtgaatgtagccaaggaagaacttttttgtttgtttaagatggagttttgctctgttgcccaggctggagtgtagcggcacagtcatggctcactgaagcctcgaccttcccagctcaagcaatcctcccacctcagctccggagtagctatgaccacacgcctggctaagttttttttttttttttgagacagaatctcactctgtaacccaagttgaagtgcagtggcacaatctcggctcactacaatctccacctcccaggttcaagcgactctcctgcctcagcctcccgagtagctgggattacaggtgtgtaccaccacacctggctaatttttgtatttttagtagagatgtggtgttgccatgttagccggggtggtcttgaactcctgacctcaggtgatctgcctgccttggcctcccaaagtgctgggattacaggcgtgagccaccagcccagcctaattttttatttttgaaaagacagggtcttgctatggtaaactcctaggcttaagcgatcctgctgtctggacctcccaaaatgctgggattacaggtgtgagccacagcccaggtcagaactttttgaaatggcccccttcagtctgtttccccttcctcccctatcccagactcaccaggggctgaaggagattcctctgttttctccggaggttgggacttggggggcagcttgactttaggctcagttccccgtttggggccgggcccttgcccttctttggcagtgccccgcggcagggtcttgtaggaggctgagaagccatcagcggtgacactgagatctgagacgaactggacgaggagttcattcccttcggaggagatggagctgcaggtggccaccgagcattgggggaagtgtcagggcgggcgtgcaccacactcttctcagccccatgaccttttttgtttgtttgagacagggtctcactttgtctcccaggcttgagtgcagtggctccatctaggcttactgcagccttgaccttctgggttcaagtaatcctcctgcctcagccccgcaagttgctgggactacaggcacgccaccatgcccagctaattattttgtatttttggtacagacaaggttgcgccatgttgcccaggctggtctcgaattcctaagctcaggtgatcctcccgcttcagcctcccaaagtgctatgattacaggcatgagccactacccctggccaggtggcttttaacttcgtcccaacttcgcagagccccagtcgcctctctatccgcggaccccagacccggggccaaatctcctctttgcctggcctccaacctgctcccctcgccggtttggagccctggggttcagatcccgtccctttagctgaaccccgcccctccaaacagccgcgtgcgtgcggtccgccgactctctcccggactcgcccaggtcccgcccctcaccccgggactgcgtcgccgcagaacttccccagcctccgggagtcgtcgctcacggctccgttgaacacgctgaccgagtcatagcggcagtaggtgtccggctccaggtcaaacttctcgaaggtcagcgcgatgacctggcggcgggcggaggcggggactgcgcggcgggacacccctgggcgcctgcacctcatctcctactgggtgcctgcagcaactcccactcccacctcccgcgtcctctgggcccccctcctgaaggcgttcacaccacagcacggaggaccacacacacccatgggaccctgcaggggtgtcggtcgtcgtggttggcaaggtcaagtcctggcgcactcacaagtgacaggcccgcgtgttataccaggaccctgtacctcgctctcctgagacttgtctcagttgtaatttttacatttttgtttgcgtgcatgcaggggttggggctgttttgggtgcccaccagcgcaagcgcagtgctcgggacacagcagatcttcaataaatctctgctggctgcaagctggagggcgccgcctgggtcccctagggcagcccggggaggagggtcggtacctggtccgggggcgcgatgatgtgccaggaacagctgatgcccggggggtaatcggactcgggccagttgggcgtggtcagggttccctgggccttctccagccgccccccgcaaaattggtgctctggggaggggagagaggagcgggggtggggggcggtggagaccctcggtcagcttcaggagaactctaggctgggagccccggcaggcagctcggatgtctggggctcaggatgagggggcgagaagaaggggaggtaagatgggggcaggttaacagagagcggccgggaggagcgcggctcggggaagtctggggccgcagggcgcactggcgggcggtggaagcgggaggaggaactggctggacgcccccttctggcccctccccgacccgcggccgcaccgcgcctcttcccctaggagatcccatctccccggccctgcagcagagtcccctttcaggctggcagagggtgtcctcgacttgcacagcccccgaggacccctttagggaggtccccgcctgaaacattgcaagggagacttctgccgccaggagggggtgatgggaccgcaatcgggagcccagggctgggtgtaggggcccccggggttggaggaacctagtccccccagccctggggtgccccctcgcgcccgacggagggagcccgattgcggacgggggccggcagttactcaccgtcccagtaaccccaggccgcccattccacccgcgggtcggtgacccatttccgcctcgcgcctggggggggccctggaagagggatgggtgggtgcgggaggaggggagagaagacggggaggagggactgaaggggcggttagtgaggaaaatgggtcagggaggtagggggccctaggcactggggcgcggggtgggcggggcggaggttagggctgggggcggggctgcggccggggcggggcctggagggggggaaggcggaggtgagggagttctcaccagtgcccgaggtggcccgcccgctgtaccagagcaggaagcctcgtcctcctgtgccctcatccgtcgtcatcctcagggtcacctggttgccgggggcgactaggggcgcaggccggaaggtcccacaaaagcgtccgagccgctggccggaagtcccagacccagcgaagacctccagagcatcgtagcggcaggcggggtgcagctccaggtcgaagactcggaatgagagggacacagtctggccctcggggacctgatagcggggacagaggcggggacccacagagtcaggccccacacaacccagccagagggcagctcccctgccccaagcgtttcttgcagaaacggactgaatgggaaggggcctccatgtgagtgcagagcagagggcctggtctctgcagctctgctggtagcctgtgcaggggacaagagctgaggctttggaagaggagggagggccggggactggagaatgaagatttgagggaagggttaagatgatgcgtgttacggtgggaatgatgccttcagtgacagagggaagacacttggagctgccccaggttgagaaggtggtgcgggggggacggggggggggtcccttcgcagtcaggcctttttgcctctgagactttaacaaggggtagtgcccagaggggtttctcaccgttatggtccagatgcactccttattaggggggtagaggttggggaacccctcacttgccacgtaacctgattcccccttcacatcccctccgcacaggaacacgggtctggagaacagaaaaggggtcaggaaagagcagggacgggtgggacgggggagcactggcaagatggggatgaggtgatgaggatgaaactccaaggagggaagctgggggatgaaatggaaaggccttgagagacctggggcagcttccaccagccaggacagggctggggtgtcccagactcccacaaagataagggaaaagtgggcctggcaactcgaccatccctccaaccccaagagtccccacccccaccccaacaggaattcccggaatcctcctcggccccccttccagactcccgcctcactctgcctggcagtccagggacaggagccgcctaactacttccagatgtggacacagccacgaggcggtaggggggagggggtggagagatggagggagctgcagtggcgatggccctctgattgaacctggaggccaggctccgcgagctccacaccttagccctgcccctgttccaaactacttcagattctgactcccaagtctccactcactgccccctcctccccctacaatccctctcgaattccttcctggaatccagctaccaggcaagttcaggagcttggctctctcttgggttctatggggggtcaaggatctgggtgggtggggagacttaagagaccagaggacgaaggtgggggaatgggagcagtggtggcctgcaggagaccaaggtcttgcagcagatggggaggatttgggggccagagaagggtgaggcggtggggaatctggggagtggtgtgtcagcaagggaacccaaaatatctccaggcataaccccaaaggaatcgggggtctgaagttcactggagctgtctggaagatgccaagagacctacctggtgtagttgggggtctggccctgggcaaaaggcagcagggcgcaggcagtgaggaggggccccaggagggaggctgtggctgcaggcagcatggccccgggggaaaggcgctggggtcctcaagacagaggcagcagctgaattttgcagagcagcagcagcggtggcggcagcagcaggataatcagcgccagatggggcagccttgggtgtgtgggcgtggggactggccagtggggcgggcaatggggaaggcgggacagtggcgtgtcctgggacctctctaggtctaggacacataaatgttgaccttaggagggggaggagcagtgaggggcagaggccgtctcccaggcctcaagtaacgtcatcgggaaccccactctgtccagtgagggagtatctccgggaacttctgaggactccctagcccccatcctccccccgcccctgcttcctcagctcaggagccctcattgctcaccccctgcctgaccacccctgccagctcattttccacttcaatttctttttttttttttttttttttttgaaacagagtctcattctgtgacacaggctggagtgcagtggcgcgatctctgctcactgcaacctccgcctcccgggttcaagcaattcttgtgccttagcctcccgagtagctgggactgcaggtgcatgcctccacacctggctaatttttgtatttttagtagaggcagggtttcagcatgctgtccaggctggtctcaaattcctagcctcaggtgatccgcccacctcggactcccaaagtgctgggattataggcgtagccaggacacctggcctccacttcacatctccattgccttctctccagacctgggccagactaggccaaggagaaggaattctcacccatgacctcttccaagtacttgaaggtacaggaagcaaggcaggaggcatggggtgtggatgaagggagtgtccttgttactcaggaagaggtggaaggagtagaaaatacagcccaaacctgggaggtaaacagaagggagagaggaggggggctggcttcaggccgaagggagatgggtgggaagctttcgggggtcaggaggaacaggctgcctcaggatggggacaagtctagtgggcagggatcccagtggggtagccaagagcatctgtgcatagagttgttccagaaggtagggccagaacttcccagtccaaacgaccaggtgtgctcttgggagcagggagtggacaacaatgtgaagggttcaggcagcatcagctctgctgcacctgagacctggagctgcttgtgctgcctgcccctgcctgggctcctgccctcctgcacccaccaagccgggcacccacccaccccatccctgcccctgtccctcccagcccccaaggcttccacaccaggcctcgctgcagccttttattctatccatcaaatctcttgtccatgatagtcaggttgggggcccctcctgggcagccccctgaacattcttaccctggttagccgtccccaccccctagcaaccccttcccacacgcatgtgcacaatggtcattgctccttagtccctggcctggggccggactccctcctccagggactaggctagcatgagggggattaggtctcaggggctgggggccctacaccacccccgcctccttcagccctctgcagcatgtccagggcctcccagaagaagtccttctgtgcggccatcaggggcatccaccctacgatctccttcatcttctccgtgcggtcctgcaacgtttggcaactgtggatctggctgaggtactcctcgcaggcctgggccatccccccggggtcctggggtgctctggcccccaggctgggctcaggagtccccaccaccctgctggctggcaggtggcgatagggggcgtgctgctcaatgtcgtggctggacaggatgtataggcactccctggtggcacagagggcacaggcacacagagggaccttggaggaggagagaaagggggcatggctgagtggtgctttccttgcagggtttcccagggtgcccgggctaatctgcctattgcattcttccctctcacaccagccctgagccggctaagtcccaggggtgtgtgaggttgggcaaggccagcacagtctgctaagggagaaagcagagagcgtggtgtgcggcagaggagggaggtggggtggtgctagggaaatgggaccccctgggtccctgcaggagccccagctacagcctgtgggcttcctggttcatggctctcatcctccctgggtgcccactctcctgaccccgctctgaccttgacttggagcttgacgaaggaggcactccccttgggccagcctgggaggcggcccccagccccacagccgcagcccagcagctccttgctgaactctgagctctggctcagcaccagggagtggttgaggccgcaccacagggtgatgggccgctgctgcaggtaacaaacctggggacacacggccagggtccctgagcagggagcaccaagggacgggggggctggggtgggaaaaggttgactggaaggctcggggcagaatgaactggggaggaggaaatgggagccagcactgtcccacgccccaggtctgccctgctgacccctgcagcccccatactctaactggtcacatagggtcttgcacttctgttggtatctcatctatgcccccagaaaatcagctccttgcctgagcccagggcctgctgtggtgtacccctcattctcagcccacccgtctatgccagtccagcctctcatcctgcctgccagcctcggggagacttgcttcttgtgcaattccaggttagaccccaacaccaccctgaggaaggactttcccttccactatccctcccttcctgctctagtattatcttttctttctttctttcttttttttttttttgtttgagacagagtcggaaggctggagtgcagcagtgcgatctcggctcactgcaacctctgccttcctgggttcaagtgattctcccacctcagcctcccaagtagctaggactacaggtccttgccaccacacccatctaatttttggatttttagtagagaaggggttttgccatgttgaccaggctggtctcgaactcctgacctcaggtgatctgcctgccttggcctcccaaagtgctgggattacaggcatgaaccactgagcccagcctccactctaccatttttattttctcttttctttttttagagatggggtctcattctgttgcccaggctgaaatgcagtggtgcaatcatagctcactgcagccttgacctcctgggctcaagccattcttctgcctcagcctcctgagtagttgggaatacaggcatgtgccaccacacccggcatgtgcctataatttttaaattttaaatttttaaattttctatagagatagtgtctcactatgttgctcatggtgatctcgaactccgggcctcccacctcagcctctagcattttttttttttttgtagagacggagtctcgctctgttgcccaagctgaagtgcagtggcacgatttcagttcactgcaacctccgcctctccagttcaagcaattctccttcctcagcctcccgagtagctgggactatgggtgcacaccgccacacctggctaatttcttttgtatttttagtagagacagggtttcaccatattggccaggctggtcttgaactcctgggctcaggcaatccacctgccttggcctcccaaagtgctaccattacaggtgtgagccatcgcgcccggccaattgttgcttctttttcaacaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaacacttccaagtctgttgtctcatctgattctcccagtagcccattacaggcccagtcattgttactgcctgcattttttttctttttttttgaaacggagtctggctctgtcacccaggctggaatgcagtggtgccatctcggctcactgcaacctctgcctcccaggttcaagtgattctcttgcctcagcctcttgagtagctgggattacaggcgcccgccaccacgtctggctaatttttgtatttttagtggagacagggtttcaccatgttggcaaggctggcctagaactcctgacctcaggtgatctgcctgccttggcctcccagagtgctgggattacaggcgtgagccagcgcacccagcctgtttcatattttttatctgcctgctccatacacacacatacaaccataaccaattatatatttagctcccttcctacatgcaatttgattttcatatctcctccatgctttgaagaggagactgagttttgaccatttctttactccatatggaaaataaaagccttccagtcaaatatttattgaagaaattaatgaaggaactcacatcatttcctttaggaccggggaagcccatgacaccaggctgacctcggggaccagatggcccaggaggacctggtcgaccactttctccttgacttccctaataagaaaaaattacattaataaaggtttgataaagagaagattaaagcatgctatatatatagtatatctctctctctctctctctatatatatatagatatacatatacatatatatatatacacacacacacacacacacactcaaggataggccaacatatacattccattttaactggccttttaaaatgagattttaaaaatgtacatacgggaggccctggtttcccatcacttcctggtcctcctggacttccgggcatgcc

SEQ ID NO: 3889 - DNA, 1623 bp, Homo sapiens
caggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcaccttttttaaaagaagtccattttgtatattagaagatgatgatgatgatgaagatgaagaaagccctggcaggatacaaagttcctcagtatttaaggagaaggatctcttccatgtccccttggacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccaggaaggtacaaggtgctatacagccgtttaaacaccccctccctggcaactgtttaaaattagaataggatttttgtatcaaccactgctagaagctttccccacctaggtggggctggcaaggggcctgcatttcccaacatccccattacaatgtttccccacttccagaaaagtctctggggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcattttggaaagggttaaacccacactgtttccgggaacttgctcccaaatactaacttgggttatcccttcctttacccagttaagaactaaagagtgtggatggaatgaaacacactggggttggggattttctgttgagggatatggcaggggcattttgggcatggagggcaaatacagaaagcaaagatttcaattcctacttggtgatttgaaatccatgacaagtcctcattcccaatctctctttaattctctcctggccctgcccacactctgtatttgaaaatcttgttttttgctctttccggagcttgcctctctgtacgtgcatattgtgaaggtgtatacatctatcattcaaaggtccagtgtgtcagcagtggtgccaccctttggtttgctagtggtactttgctgtgtactccgtggcatcgtgtgtgctgtgtgcatagtttcattttaatgcccgct

SEQ ID NO: 3890 - DNA, 1840 bp, Homo sapiens
cgcccgggcaggtcccaaaattaggggggaagaggaaaaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggtagggatcgggggccggcgtgggtggggtcccatggagtactccagcacacgcaggggctccctgcagacagggggggccttcgccctggaagcctggacgccgagatagacttgctgagcagcacgctggccgagctgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcttctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggccaccctggagaaatgtgccacgtgctcccagcccatcctggaccggatcctgccgggctatggggaaggcctaccaccctggctgcttcacctgcggtggtgtgtcaccgcgggccctcgacggcatccccttcacagtggatgctacgagccaagatccaactgcatttgaggactttcacaagaaaagtttgccccccaaaatgcctcagtgtgcggtggggcccataaatgcctgagcccaggtcaggaggagacttttaagaaattgttgctctggatcgaagtttttcacattgggctgtacaaagtgcgaggagtgtgggctgcttgctctcccttctgagggcgagtgtcagggctgctacccgctggatgggcacatctttgtgcaaggcctgcagcgcctggcgcatccaaggagctctcagccaccgttcaccactgactgctgagtctttcctagaagtacctgctgggttctcagttccagttcccatcctttgattgatcactctccctgacatccacctgtatgactttgtcaccaaatgctgtcttctctttctccaatcaagaaataactaatccctcgagtttacaaaacacttccaagtctgttgtctcatctgattctcccagtagcccattaaaggcccagtcattgttaaaaaaaaa

SEQ ID NO: 3891 - DNA, 1804 bp, Homo sapiens
  misc_feature (1)...(1804): n = A,T,C or G
ctgctgctgctctgcaaaattcagctgctgcctctgtcttgaggaccccagcgcctttcccccggggccatgctgcctgcagccacagcctccctcctggggcccctcctcactgcctgcgccctgctgccttttgcccagggccagacccccaactacaccagacccgtgttcctgtgcggaggggatgtgaagggggaatcaggttactgtggcaagtgaggggttccccaacctctacccccctaataaggagtgcatctgggaccataacggtccccgagggccagactgtgtccctcttcattccgagtcttcgacctgggagttgcaccccgcctgccgctaacgatgctctggaggtcttcgctgggtctgggacttccggccagcggctcggacgcttttgtgggaccttccggcctgcgcccctagtcgcccccggcaaccaggtgaccctgaggatgacgacggatgagggcacaggaggacgaggcttcctgctctggtacagcgggcgggccacctcgggcactgagcaccaattttgcggggggcggctggagaaggcccagggaaccctgaccacgcccaactggcccgagtccgattaaccccccgggcattcagtttttcctgggacatcattcgcgcccccggaccagggtcatcgcgctgaccttcgagaagtttgacctgggagccggacacctactgccgctatgactcggtccagcgtgttcaacggagccgtgaacggccacctccgggagggctggggaagttctgcggcgacgcagtcccggggctccatctcctccgaaagggaattgaatcctcgggcaggtttgtgtcaaattccagaggtcccccggtaagggctttccagtctcctacaagaccctgccgcggggcacttgccaaaggaagggcaaggggcccgggcccccaaacggggaaactgagcctaaagtcaaggctgccccccaagtcccaaccatccggagaaaacagaggaatctcctttcagccccttgatgcacccaacctgcccaaaagcaggtgccgcggggacaggaacctttgcagagccaactttctgtggccaggcagcctttgtggtgactgcggacagtgaagtccatggtttcgggagcccaggggagggccttgccgtgacatgtcagttttatttggtgcttataaaactgggaggactggaccttgccttcttccacccactggtgcctccctgaagtttttacgtgccattgcaagcaagtgcccccccattgaagaaaggagtcagttatctgctggatgggccatggtagaagagaacagaggcccccgtccttcctccaagagagcttttgtgggttctccaccggcccaaccaaggaccaagatcctcatcatcaataagcaaaagatgagtgcccctgttaacctgtgcgggatgctagcgtacccaggactggagacgcagatccagccgccggcccgctagccctgcaggccttctttcttcatgggggggcactgcttgcaaggcacgtaaaacttcagggaggcaccagtgggtggagaaggcaggtccagtcctccagttttataagcaccaataagacttgacagtcacggcaaggccctcccctggctcccgaaccatggacttcactgtcgcagtcaccacaaggctgctcggcacagaagtttgctctgcaaggtgcctgtccggcggcactgcttttgggcaggtgggtgcatcagggnctgaaggagattcctctgttttctcgtc

SEQ ID NO: 3892 - DNA, 2321 bp, Homo sapiens
tttttttttttttttttccttttttttcttttgtgttaagtcacttgtttatttctcaagatgtgcacactcaagtgtgaagctggccgggacaactcatggctcctatggtatgtacaggccctttgatggcttgggttacagacaaacctcatagctggtgcaccacacacacgagataaaacaggaagccttaaaaccccaagccacaccaagaaaaatgagaaaggggagggccggggtaacaatgcaggcattcccgcggagggaaccttaatgcacaaggagggagaacaagagggtggaaaggcaagccagctttcgtcttcgccgcccgcagctgctgtgtgggtgggtcagggggcctgagtttcaacaggtcctttcagggaagcttttctgggatcggtgattttttgattaaaagaccgggccacatccgaggaactctgaagaaggtcttccacttgggcatgaactccctccttggaaggtttttcagggctttgtcggcaagcttccgtaagatgggcaatgtcgttgtggcggatgtactcagcgagagagccaggaccagcctcccttctgtgtttactggtaggcaacctttcttaaacatgttgtaaaatgagatcgacgaagggccccaaaaaggagaagggaaagaacggttaagcggaatagtccttcactgcctttatcttgtcagccttgggtggctccacctggagccactgcccgagcctgcgaaggtcaccatcagcctccgccaagatttccacacgtgtggctctccactgctcagggggcaggatgtgaagggccaagactgtgaaatagtagggcccgtccactacaaaggcactctccacccacttctccttgggctgttccagaaagccttggaggttcttctcttctcgggaagttgctcgggttgtgttcaggacgtaaagcacagtgtgaatgatgtacgggatcaggtggatgttgctctcccggccgcccccgccagtgtctgcgctgaacgactgctccatggcgaagcgcaggaagagcagtttgatgtcatggatgttgagctgatacgtgggctcccgctggcctgtacattcctggaggtaagtgttgtgtcttgccaagcaagtggcaaaagctgattcagggacatgaggtccccagaccggaaggagccccgttgcacttggttgttgggcattctgcagggcggcactctcccactcttcccggcctcgagccaacctgacggcaagccagatgggcagtcgtagtgcacaaatgttgaagtgggacacggtgctgtagccctgctggtttcccggggcttattctcccaaactcctccaaggctacccgcttcgtgaaggtataaatgcccaggacctttgtgggctggaacttgtatccctccctgcagatgcagcacgtgaggccaaggctcctcgatcagctcttcccaatctgcttcaaggagtgctgtcttggtcaacgacctggcccttttcatttgtcgtcaatgcccagggtgcccagggccttctgcctcattgccatggccatgcgtttcttctctgcccgggtcctcctgcgggctggcgtcaatcttcttgtttacgtcagggtgttcccgcaggctttccagccaggttctcttgccaaggtcccaatgccctcatcactgggacacctgctccagcttatgcaggttcgggatggaatcagttccaatcagaacctgggtgccagggtgctggatggccaggccccgaagcagccttaggataaatggcaaggctgggcgagacaaaaactttttccagatgtcggcatccaaattcttggcgctagggatgtgctttttcatgtagtcaagtgcattctgggtgatccccttctggagaatcagatccttcagctggtgcccattgctgttgttcttgatgccagcagctattttacagaagcagtccaggaagactttatcatcaccactgtgatcttcatcatatttatcaaagttgcagtatggtttgaatcgctccaccaagatctgcattttctccacctctccaaaggaaaggtacgggatgatgcgaagcaggccctggagcacactggggttggagcgaacaaaggtgctgttgatctggtccaagagcatcaccagttgatccttgtcacctgtcaggaggaggttgcccttgtcctcactcaggggctcaacattgggctcagcttgtataaatctccatgatgctaagcacctgctcagccacagctgcaaccccactgtccttgct

SEQ ID NO: 3893 - DNA, 1387 bp, Homo sapiens
ccggcggcgcctcaggtcgcggggcgcctaggcctgggttgtccttcgcatctgcacgtgttcgcagtcgtttccgcgatgctgcctctgctgcgctgcgtgccccgtgtgctgggctcctccgtcgccggcctccgcgctgccgcgcccgcctcgcctttccggcagctcctgcagccggcaccccggctgtgcacccggcccttcgggctgctcagcgtgcgcgcaggttccgagcggcggccgggcctcctgcggcctcgcggaccctgcgcctgtggctgtggctgcggctcgctgcacaccgacggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaaaatccccgttccctttcaacattaacaacagcattccccccaacatttgatggtgaagaggaaaccctcgcaagggccagaaggtttgaagaacaggagcctgaactgacatcaactccccaatttcgtgggttgaagttataaagaatgattgatggcaagaaaggcccttgtgttggaccgttcattatccaaaggatgaggttgaccaagaagacgaggctgagagtacatttttctctatcaggggaagttagcttttcagtcccactgggcgagtctggaatgggaagggatactaatttattacacttcaacacagattccttttggactgggcccttatatgacccacctaatgggatttccttgccgacccgaggggtgggacaacacttttggcaggatgagctgggtgggagctcagcacagccccccggagcccccccggagtacattacttttccttgaagaccctcaagagttttgctcaagagcccagtagagcagacagatgctgaaagcccatagtttccatggccaggctttggcccagtgaacaaatccctactctgaagcctagacatgtgtctttgaaatgattatcatcctaatatcatggggggaaaaaataccgaaatttaaattatatgttttgttgttcttcatttattattcatttttttctgtacaaatctaattattttctagattttttgtataacatggatagacataaacacctggtttatctcctgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaacaaaaaaaaaaaaaa

SEQ ID NO: 3894 - DNA, 1835 bp, Homo sapiens
  misc_feature (1)...(1835): n = A,T,C or G
atcctcgccaccctcggcctgcggtcagccctcggcccgcagatggatggcgggtcagggggcctggggtctggggacaacgccccgaccactgaggctcttttcgtggcactgggcgcgggcgtgacggcgctcagccatcccctgctctacgtgaagctgctcatccaggtgggtcatgagccgatgccccccacccttgggaccaatgtgctggggaggaaggtcctctatctgccgagcttcttcacctacgccaagtacatcgtgcaagtggatggtaagatagggctgttccgaggcctgagtccccggctgatgtccaacgccctctctactgtgactcggggtagcatgaagaaggttttccctccagatgagattgagcaggtttccaacaaggatgattatgaagacttccctgtaagaaaagtttgtgaaagggagacctcctacgagatgatgatgcagtgtgtgtcccgcatgttgggcccaccccctgcatgtcatctcaatgcgctgcatggtccagtttgtgggacgggaggccaagtacagtggtgtgctgagctccattggggaagattttcaaagagggaagggctgcttggggattcttccgtttgggttaaatccctcacctcctggggcgatgtggttttcttgtgggggctgtaaacctgctggcccactttcatcaatgcctacctggtggatgacagtttcagcccaggccctggcattccggagctataccaagttcgtgatggggattgcagtgagcatgctgacctaccccttcctgctagttggcgacctcatggctgtgaacaactgcgggctgcaagctggggctccccccttactccccagtgttcaaatcctggatttcactgctggaagtacctgagtgtgcaggggcagctcttccgaggctccagcctgctttttccgccgggtgttcatcaggatcatggttttgccctgggagtaaacctgaaatcatctaaaaaacacggttcttcaacctggtccaccgtgggtgtaggcctgaccaccttgggacacctgcaagacgactccaacccaacaacaaccagatgtgctccagcccagccgggctttcaagttccatatttgccatgtgtctgttccagatgtggggttgagcgggggtggggctgcacccagtggatttgggtcacccgggcagacctaggggaaggttgagggcgaggttggagtttggcagaatccccatacctcgcagatttgcttgagtctgtttttgttgcagagggccagagaatggctttatggggggcccaggttgggatggggaaaggctaatggggtcagaccccaacccggtcttaccccttccaagtcaagcccagcgccccatcctgcagcttcaagctgggagcatcattctcctgctttgtaacatagggtgtggtcccctggcaacgtggccaccaatcatgtcttaggcctatgcttaggaggcaaaatgngccagagctctgcctgtggtttttctcaacactacttttctgatatgagggcagccccctgccttctgaatggggaaattcatggcaactacttcaggaatgtgtcctcctcatctaaatgctcaatctagtttaatggtgatgccctcgcgtaacaggatctggttacctgccaccctctcaccccacccccacctgttctgtatgtttgaattctttcagtagctgttgatgctggttggacaggtttgagtcaaattgtactttgctccattgttaattgagaaactgtttcaataaaatattcttttctacaaa

SEQ ID NO: 3895 - DNA, 5629 bp, Homo sapiens
  misc_feature (1)...(5629): n = A,T,C or G
atggcagaaggtgtgaatgagccttgtttcccgggggactgtggcatatttgtcactaaagtggacaaaggaagcattgctgatggccgcttaagggtcaatgactggctgctgagaatcaacgatgtggacctcatcaacaaggacaagaagcaggccatcaaggcgctcctcaatggggagggggccatcaacatggtcgtgcggcggaggaagtccctgggtgggaaggtggtcacgccgctgcacatcaacctcagtggacagaaagacagtggcatcagtctggagaatggagtgtatgctgccgctgtgctgcctggaagccctgccgctaaagaagggtcccttgctgtgggagacaggatcgttgcgatcaatggcattgcactggacaacaagtctctgaatgaatgtgaatctctgctgcggagctgccaggactccctgaccctgtccctcctgaaggtattccctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgcttcagttcctgggaggaacaggaagtgtgttcccgggccagtgggagaatttttccccggagctccaggagtgggcaccttactcgcctgggcattccagccggcacagcaaccccccgctataccctagcaggccgtctgtgggtactgttccccggagtttgacccccagcaccactgtgagctccatcctgcggaaccccatctacactgtgcgcagtcacagggtcggcccctgcagctctccacctgcggcccgagatgctggcccccagggtttgcatcccagtgtccagcaccagggacgcctgagcctggacctgagccacaggacctgcagcgactactccgagatgagagccacccatgggtccaactcactgccctccagcgcccgcctgggttcttcgagtaacttgcagttcaaggcggaacgcattaaaatcccatcaacaccaagatatccgcggagtgtcgtgggctccgagagaggttcagtgtcacattctgaatgcagcactcctccacagtcacccctgaacatcgacaccctgtcctcttgtagccagtcccagacctcagcctccacattgcccagaatcgctgtcaaccccgcgtccctcggggagcggagaaaggacaggccttatgtggaggagccacgccacgtgaaggtgcagaagggctcagagccgctgggcatctccatcgtgagtggagagaagggcggcatctacgtctccaaggtgaccgtggggagcatcgctcaccaggctggcctcgagtatggggatcagttactggagttcaacggcataaacctgcggagcgccacggagcagcaggcgcggctcatcatcgggcagcagtgtgataccatcaccatcctggcccagtacaacccccacgtgcaccagctcagcagccactcccggtccagctcacacctggaccctgccggtacccactccactctccagggcagtggcaccaccaccccggagcatccatctgtcatcgacccactgatggagcaggacgaggggcctagcacccccccagccaagcagagcagctccaggattgcgggagatgccaacaagaagaccctggagccacgcgttgtcttcatcaaaaagtcccagctggagcttggggtgcacttgtgtggtgggaacctgcatggggtgttttgtggcccgaggtggaggatgacagtcctgccaagggtcctgacggcctcgtgccaggggacctcatcctggagtatggcagcctggacgtgcggaacaagacagtggaggaagtctatgtggagatgctgaagcccagggatggcgtccgcctgaaggtgcagtaccgccctgaggagttcacgaaggccaagggcctgcctggtgacagcttctacatcagggccctgtacgaccggctggcagatgtggagcaagagttgagctttaagaaggacgacatcctctacgtggatgacaccttaccccagggcacgttcgggtcctggatggcttggcagctgggacgagaatgcccagaagatccagcgcgggcagattcacagcaaatatgtgatggaccaagaattctccaggaggctcagcatgtctgaagtcaaagatgacaatagcgccacaaagacgctgtcagcggctgcacgccggtccttttttcggaggaaacacaagcacaaacgcagcgggtccaaggacgggaaagacctgctcgccttggatgccttttccagtgactccattccactctttgaagattcggtgagcctggcctatcagcgggtccagaaggtggactgcaccgctctgaggcctgtcctgattctggggcctttgctggacgtggtgaaggagatgctggtgaatgagggctcctgggcaagttctgcagatgtccccttgaggtgatgaaggcctcccagcaggccattgagcggggtgtcaaagattgcctgtttgtcgactataagcggagaagcggccatttcgatgtgaccactgtggcgtcaaataaaggagatcacaagaaaagaaccgacacttgcctcctggacattgctccgcacgctattgaagcgggctccaccacatgcacatctaccccattgtcatcttcatccactacaagagcgccaagcacatcaaggagcagagagaccccatctacctgagggacaaggtgactcagaggcattccaaagagcaatttgaggcggcgcagtaagcttgaggcagggagtacagcaggtactttcacaggggtcatccagggggaggagccctgttcaaggcattttgcacttcagatttttggcaatggtcaatcaagaacaaaataaagtcctgtggattccagccctgcccgctctaggagaatgctgtgctgtggatgactgcagctggccgcctgaggggacgccagactcagctcttttctagcgactgaaagtagaagtctgtccgtctatgaacatgcaggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgttcaaccccctgttcgctttgggtgttggttttcgttcccgtctttcagcaaaacgaccttgggaacctcaatgggggctgctttgctttggggaggttcttgttgggtggggaccagagctttgacaaacctcctgctccttgggtgggcacctcttcctggggaaggaacgttcacaaacttccagggtgcttcagaattgcctgtggaaccaggaaacccagtggcctttggatttttttccttncccacaatgggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggcttttttttttttttgcacttctgaggctagatatgtctggctgaagatttgatgtgggtccctccttaagctatgcggccctgtttaataataggggctgtactgggctctgtttaagtgtcgttgggggtaggacccctatattttttaatacctgttccctaaccattccattttacctagccgagaaaacctttgaatttccattttaatcctttggtaaatcctagaacactaggattgtagtttagccccataactgatgttttttaaaaaaagggataatattttccttgccacagttgttccaaaaaagagacaaagtttcagtcctccaatgctgtcctttggttttacaggtacaagttttctaggctcaggacaaactatggaaaaactgtaggactattctccaagggtattaacctcgcagaccctatgggggtagggggccgtttttctaaaggttacaggcagagtgggactgagatgcgtacagtgtgcacagacaggtactgagctgacagactgggatttcccgtactaaaatgttactttgtatcacaaagttaaagcaggctttagtacaacaaataaaggtcaatttctgtaaaaaaaaaaaaaaaaaaaaaaaaaaaaaa

SEQ ID NO: 3896 - DNA, 4623 bp, Homo sapiens
ggagttgtgaagggcgcgggtggggggcgctgccggcctcgtgggtacgttcgtgccgcgtctgtcccagagctggggccgcaggagcggaggcaagaggggcactatggcagacaaagttaggaggcagaggccgaggaggcgagtctgttgggccttggtggctgtgctcttggcagacctgttggcactgagtgatacactggcagtgatgtctgtggacctgggcagtgagtccatgaaggtggccattgtcaaacctggagtgcccatggaaattgtcttgaataaggaatctcggaggaaaacaccggtgatcgtgaccctgaaagaaaatgaaagattctttggagacagtgcagcaagcatggcgattaagaatccaaaggctacgctacgttacttccagcacctcctggggaagcaggcagataacccccatgtagctctttaccaggcccgcttcccggagcacgagctgactttcgacccacagaggcagactgtgcactttcagatcagctcgcagctgcagttctcacctgaggaagtgttgggcatggttctcaattattctcgttctctagctgaagattttgcagagcagcccatcaaggatgcagtgatcaccgtgccagtcttcttcaaccaggccgagcgccgagctgtgctgcaggctgctcgtatggctggcctcaaagtgctgcagctcatcaatgacaacaccgccactgccctcagctatggtgtcttccgccggaaagatattaacaccactgcccagaatatcatgttctatgacatgggctcaggcagcaccgtatgcaccattgtgacctaccagatggtgaagactaaggaagctgggatgcagccacagctgcagatccggggagtaggatttgaccgtaccctggggggcctggagatggagctccggcttcgagaacgcctggctgggcttttcaatgagcagcgcaagggtcagagagcaaaggatgtgcgggagaacccgcgtgccatggccaagctgctgcgtgaggctaatcggctcaaaaccgtcctcagtgccaacgctgaccacatggcacagattgaaggcctgatggatgatgtggacttcaaggcaaaagtgactcgtgtggaatttgaggagttgtgtgcagacttgtttgagcgggtgcctgggcctgtacagcaggccctccagagtgccgaaatgagtctggatgagattgagcaggtgatcctggtgggtggggccactcgggtccccagagttcaggaggtgctgctgaaggccgtgggcaaggaggagctggggaagaacatcaatgcagatgaagcagccgccatgggggcagtgtaccaggcagctgcgctccagcaaagcctttaaagtgaagccatttgtcgtccgagatgcagtggtctaccccatcctggtggagttcacgagggaggtggaggaggagcctgggattcacagcctgaagcacaataaacgggtactcttctctcggatggggccctaccctcaacgcaaagtcatcacctttaaccgctacagccatgatttcaacttccacatcaactacggcgacctgggcttcctggggcctgaagatcttcgggtattttggctcccagaatctgcccacagtgaagctaaaaggggtgggtgacagcttcaagaagtatcctgactacgagtccaagggcatcaaggctcacttcaacctggatgagagtggcgtgctcagtctagacagggtggagtctgtatttgagacacttggtagaggacagcgcagaagaggaatctactctcaccaaacttggcaacaccatttccagcctgtttggaggcggtaccacaccagatgccaaggagaatggtactgatactgtccaggaggaagaggagagccctgcagaggggagcaaggacgagcctggggagcaggtggagctcaaggaggaagctgaggccccagtggaggatggctctcagcccccaccccctgaacctaagggagatgcaacccctgagggagaaaaggccacagaaaaagaaaatggggacaagtctgaggcccagaaaccaagtgagaaggcagaggcagggcctgagggcgtcgctccagccccagagggagagaagaagcagaagcccgccaggaagcggcgaatggtagaggagatcggggtggagctggttgttctggacctgcctgacttgccagaggataagctggctcagtcggtgcagaaacttcaggacttgacactccgagacctggagaagcaggaacgggaaaaagctgccaacagcttggaagcgttcatatttgagacccaggacaagctgtaccagcccgagtaccaggaagtgtccacagaggagcagcgtgaggagatctctgggaagctcagcgccgcatccacctggctggaggatgagggtgttggagccaccacagtgatgttgaaggagaagctggctgagctgaggaagctgtgccaagggctgttttttcgggtagaggagcgcaagaagtggcccgaacggctgtctgccctcgataatctcctcaaccattccagcatgttcctcaagggggcccggctcatcccagagatggaccagatcttcactgaggtggagatgacaacgttagagaaagtcatcaatgagacctgggcctggaagaatgcaactctggccgagcaggctaagctgcccgccacagagaagcctgtgttgctctcaaaagacattgaagctaagatgatggccctggaccgagaggtgcagtatctgctcaataaggccaagtttaccaagccccggccccggcctaaggacaagaatgggacccgggcagagccacccctcaatgccagtgccagtgaccagggggagaaggtcatccctccagcaggccagactgaagatgcagagcccatttcagaacctgagaaagtagagactgcaggatccgagccaggagacactgagcctttggagttaggaggtcctggagcagaacctgaacagaaagaacaatcgacaggacagaagcggcctttgaagaacgacgaactataacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggaacagctcactggttccttctgcagtacctctgtggttaaaaatggaaactgttctcctccccagccccactccctgttccctacccatataggccctaaatttgggaaaaaatcactattaatttctgaatcctttgcctgtgggtagggaagagaatgggctgccagtggctgaatggggtcccggttgatgggaagggtattcaggttgctgggggagtttccactcttctctgggtgattgttcctttcccttccctttcctctccccaaccatgcgatgagcatcctttcaggccagtgtctgcagagcctcagttaccaggtttggtttctgagtgcctatctgtgctctttcctccctctgcgggcttctcttgctctgagcctcccttccccattcccatgcagctcctttccccctggggttttccttgggttcctgcaggcaaattggggcagttcttcttgcccctttgcctaaaaagcctgtaacctctgggaatgggcggaagtaaatctggaaggattctcactccgtatttcccacccctaagttggccagaggagggaggaggcacagtgaagaaagggaagcccaaccaacctcttccgaagaggaaaagccacgtagaattggtttggcaatggggggtgcaagcaatcgtgcaaagctctgttcataatctgcatcttcccagcagcctggtaccccaggttcctgtaactccctgcctcctcctctcttctgctgttctgctcctcgcaggacacagcctgtccctcaccccctgaccccctggggcttgaccaaaattttgctttctaactgggagtccctatccccaagatcctgggggaaaggagagacccatggtgtggaatgtagagattgccacctcccctctctcctgaaggcaggccctgtggaatgaaaggaggagggttcagggctggcccttccctctgttgcattcattcttgttaaggtttggggggccccccgaccccacccataccctacgccctaggggagcccgtccctcccagtaatccgtctgtagcaggagctcagggctgcttgcctcagctcccaagacaagaatgaaccctggctgtgtcagtcattttgtcttttccttttttttttttttttttgccacattggcagaagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctccaaaaaaaaaaaaaaaaaaaaaaa

SEQ ID NO: 3897 - DNA, 5723 bp, Homo sapiens
  misc_feature (1)...(5723): n = A,T,C or G
gacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgttgtctgtgactcaggatccgttctctgcgatgacataatatgtgacgatcaagaattagactgccccaacccagaaatttccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtcgggcggagtagcagtaggaggactcgcaggctatcctggaccagctggccccccaggcccccccggcccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagaccgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaccctggtgcaaatgggcttccaggagctgcaggagaaaggggcgcccctgggttcccgaggacctgctggaccaaatggcatcccaggggagaaaggccctgctggagagcgcggtgctccaggccctgcaggccccagaggagctgctggagaacctggcagagatggcgtccctggaggtccaggaatgaggggcatgcccggaagtccaggaggaccaaggaagtgatgggaaaccagggcctcccggaagtcaaggagaaagtggtcgaccaggtcctcctgggccatctggtccccgaggtcagcctggtgtcatgggcttcccccggtcctaaaggaaatgatggtgctcctggtaagaatggagaacgaggtggccctggaggacctggccctcagggtcctcctggaaagaatggtgaaactggacctcagggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggcccaggtgctgatgggtgtcccagggaaagatggcccaaggggtcctactggtcctattggtcctcctggcccagctggccagcctggagataagggtgaaggtggtgcccccggacttccaggtatagctgggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccactctggattgcttgggatcactgtagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttcccaggccgaagatggaatctccctggtggcaagggtgaatcgtggtgaaaaatggcttctccctggtccccctggcgctccctggtcatcccaggcccaccctggtcctgtcggtccagctggaaagagtggtgacagaggagaaagtggccctgctggccctgctggtgctcccggtcctactgggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggttgcaatcggcagtccaggacctgcaggccccagaggacctgttggacccagtggacctcctggcaaagatggaaccagtggacatccaggtcccatttggaccaccagggcctcgaggtaacagaggtgaaagaggatctgagggctccccaggccacccagggcaaccaggccctcactggacctactggtgcccctggtccttgctgtggtggtgttggaagccgctgccattgctgggattggaggtgagagagctggcggttttgcccccgtattatggagatgagccaatgggatttcgaaatcaacaccgatggagattaatgagttcgatcaggtctggttagtggaacaaatggaaaagcctcaattagttcctgaatgggttctcggtaaaaacccccgctaggaaactgcagagaccctgaaattctgccatcctgaactcaagagtggagaatactggggttgaccctaaccaaggatgccaattggattgctatcaaggtattcttgtaattatgggaacttggggaaacattgcataagtgcccaatcctttggaatgttccacgggaaacactggtgggacaggttctaggtgctgaggaaggaaacacgtttggtttggaaaagccccatgggatgggtgggttttccagttttagcctacggccaaccctgaacttccctgaagatgtccttgatgttgcagctgggcattctttcgacgactcttctccagcccgagctttcccaggaacatcacattatcactgcaaataatagcattgccatacatgggatcaggcccagtgggaaatgtaaagtaagcgcctgcaagctgatgggggtcaaaatgaaaggtgaatttcaaggctgaagggaaataggcaaatttcaccttacacagtttctgggagggtggtttgcacgaaacaccactggggggattgggagccaaaacagtcttttggaatattcgaaccacggcaagggctgttgaggacttacctatttgttaggatattgcacccctatggacatttgggggtcctgattcaagaatttgggtgtggacgttgggccctggttttgcttttttataaacccaaactctatctgaaaatcccaacaaaaaaaaatttaactccatatgtggttcctcttggttctaatcttgtccaaccagtggcaagtggancggacaaaatttccagtttatttattttcccaaaatgttttgggaaacagtataatttggacaaaggagaaatggatacttctcttttttttgctggttccacccaaatacaattccaaatggctttttggtttaaatttttttacccaatttcccattttccaaatggtcctcaatgggtggctataattaaataaactttcaacactcctttatggataaccacactgtgttatattctttggaatcctagcccatctgcagagcaatgactgtgctcaccagtaaaagataacctttctttctggaaatagtcaaatacggaaattaggaaaggccctccctattttgaactacctcaactggttcagaaacacagattgtattctatggagtcccagaaggtggaaaaaaattttatacgttgataaaagcttataaatttcattggattaatctcctgggaagattggtttaaaaagaaaagtgtaatgcaagaattttaaagaaatatttttaaagccacaattattttaatattggatatcaactgctttgtaaaggtgctcctcttttttcttgtcattgctggtcaagattactaatatttgggaaggccttaaaggaggcatgtttatggtgctaatggtactttccccgtttaaacttctagatcagaattgttggacttggcattcaggaacataaatggcacaggaatctggtacatgtctcccatcagaaagattcattggcatgccacaaggggattctcctccttcatcctgttaaaggttcaacaataaaaaaccaaatttatgggggctgcttttgtcacacctagcataggagaatgtgttgaaattttaactttgtaagcttggtatgtggttgttgatccttttttttccctacagacaccccataataaaatatcatattaaaaaaaaaaaaaaaaaaaaaaaaaaaaaaaaaaaaaaaaaaaaaaaaaaaaaaaaaaaaaaa

SEQ ID NO: 3898 - DNA, 11659 bp, Homo sapiens
  misc_feature (1)...(11659): n = A,T,C or G
acgccatcctgaggacccagctgcacccctaccacagcacctcgggcctaggctgggcggggggctggggaggcagagctgcgaagaggggagatgtggggtggactcccttccctcctcctccccctctccattccaactcccaaattgggggccgggccaggcagctctgattggctggggcacgggcggccggctccccctctccgaggggcagggttcctccctgctctccatcaggacagtataaaaggggcccgggccagtcgtcggagcagacgggagtttctcctcggggtcggagcaggaggcacgccgagtgtgaggccacgcatgagcggacgctaaccccctccccagccacaaagagtctacatgtctagggtctagacatgttcagctttgtggacctccggctcctgctcctcttagcggccaccgccctcctgacgcacggccaagaggaaggccaagtcgagggccaagacgaagacagtaagtcccaaacttttgggagtgcaaggatactctatatcgcgccttgcgcttggtcccgggggccgcggcttaaaacgagacgtggatgatccggagactcgggaatggaagggagatgatgagggctcttcctcggcgccctgagacaggagggagctcaccctggggcgaggttggggttgaacgcgccccgggagcgggaggtgagggtggagcgccccgtgagttggtgcaagagagaatcccgagagcgcaaccggggaagtggggatcagggtgcagagtgaggaaagtacgtcgaagatgggatgggggcgccgagcggggcatttgaagcccaagatgtagaagcaatcaggaaggccgtgggatgattcataaggaaagattgccctctctgcgggctagagtgttgctgggccgtgggggtgctgggcagccgcgggaagggggtgcggagcgtgggcgggtggaggatgagaaactttggcgcggactcggcggggcggggtccttgcgccccctgctgaccgatgctgagcactgcgtctcccggtccaacgcttactggggcaggagccggagcgggaagacccgggttattgctgggtgcggacccccacctctagatctggaaagtaaagccagggatggggcagcccaagcctcttaaagaggtagtcgggccggtgaggtcggccccgccccggccccattgcttagcgttgcccgacacctagtggccgtctggggagccgctagcgcggtgggagtggttagctaacttctggactatttgcggactttttggttctttggctaaaagtgatctggaggcattggctggctttggggacggggacggccccgagagcgggcttttaagatgtctaggtgctggaggttagggtgtctcctaattttgaggtacatttcaagggggggcctcccttcccaatcagccgctcccattctcctagccccgcccccgccaccccacctgcccagggaatgggggcgggatgagggcctggaccttcccttctctcctccctcgccctcctcctgtctctaccacgcagccactccccacgagcctgccctcccgatggggcccctcctattctccccccgccctccccctctcaccctgtggttttatttcacttggcttcagcgccaatgggctgaggttggagttggaagccaccgcagactaaagctttgtttaaattcctgagaactggaaagagttacagcctccctggccaggcgcctcggcnggtcacccgcgctgatgaggagcaggcgagcttttaaggatttgaggaaagaagaacggggggaggggcgggaagtgaaaaatccaagtgtgcctcttagacccgggggaaaggtggttaagctgggggttgcagtcactactgacaacgcccctcttccgcctgtcccagtcccaccaatcacctgcgtacagaacggcctcaggtaccatgaccgagacgtgttggaaacccgagccctgccggatctgcgtctgcgacaacggcaaggtgttgtgcgatgacgtgatctgtgacgagaccaagaactgccccggcgccgaagtccccgagggcgagtgctgtcccgtctgccccgacggctcaggtgcgctgcgctcggcctggggcctggggctggggctgggggtggtcggcgctcgctggccctccgtgctggaggcctctgccgacgggagcagcattagcaaaccttggctctaacgggcgtctcttcgtcccctagagtcacccaccgaccaagaaaccaccggcgtcgaagtaatctcctgccctcgaattttgcccctgcgcggcccgtgactcctcacagtcctcccttctctaacctggcctcttgtttcttctcccccaatcccacagggacccaagggagacactggcccccgaggcccaagggtaagcgttgcactctgggctgtggggggctgcaaggtgggcatggctctcggccccacgctcaccccggccccgccctctcccctgcagggacccgcaggcccccctggccgagatggcatccctggacagcctggacttcccggaccccccggaccccccggacctcccggaccccctggcctcggaggagtaagtggagaggccttgtgtgtccactctcccctgttttgtttttgttttttggcagatgacataattttaatactttgaaataatttcaaacttacagaaaagttgcaagaatcctacaggaaactctcacatacccttcacagtttgtgacatgtgctttattagtctctgtttatgtatatgtatctttttttttctgaactgtttgagcaagttgctaacatcaggctcttttgcgcctaaatacttaggtgtgtttttcctaaaaacaagagcattctcttaactgacctacacaatgattaaattcactctctaatgtgcagtccgtactcaaagttcaccgatgtcccgataatgtcctttatagattccaacccccaccaccccaatctgggatccagtccaggattatgtattgcatttaatcatcatgtctctagtttccacaaatgtagaacgttcctcagactttctttgtctttagtggcactgggagttttgatgagtccagttgttttgcagactgtccctcaatttgggattgtctcattagattagatgcagggatgcatctttggcaggaatgtcttaaaagcaatgttattcttctcagcacatcacaccaggaagtgcatgatgtcagtttcttccatcctcagtgccgtcttctgcctttcaattcactgtcctcactctgacttctcttgtttgttctagaactttgctccccagctgtcttatggctatgatgagaaatcaaccggaggaatttccgtgcctggccccatggtgagccagcagggggagcatggatgacagaagagagaatgggtatccagaggaggtgggcataggcggctggtatagacagcttgggaggtccagttcacctttgggacctcagagtccagaaaggatgcaggactgaacttgggttggtcccaacaggcatgaattgacttacatccacatgactttcctacagagggatcaccatgacccccctttcttctccctctatagggtccctctggtcctcgtggtctccctggcccccctggtgcacctgtgagtatccaggacgtcttcatatgcctccttgggctttggtcttttggagggaagactgggatgagggcaggagagatgctcagagatctcacttggtnggttgacgggcttcgtcctccaacccatctttttccttcctctcaagggtccccaaggcttccaaggtccccctggtgagcctggcgagcctggagcttcagtaagcactctctatacagattcatactccttctacaaacacacagactctcctatagaagaactcccaggcctggggtctttcttacctcttcccttcaatcccagccttccccttctttttttcttatccatattctaaccacctcttctatcttttctagggtcccatgggtccccgaggtcccccaggtccccctggaaagaatggagatgatgtaagtatcccagcaatgcggtcatctcagacccatggcctacatgggtgtgggtgctgcaatttccgctncggcagacagttgggaacgatactcanaggaaggaagggcaggtcctctcatgatgcacggactgccctcgaacatgatcttttcgcttagtgagatgattccatgtccccaacaacagtgactgtctcctcaccccagccaccgttgagaggcaatccccaaccccatccttgggcaaatgtgcggagatgtgaaattaaaatgctgtgacagaagtagacagaaattcctttagaggcactcagaatttcaccaaacgaaggtttcactgtagatttaaactgagctctagatcaagatatatctggccccaaacctgacctgcaacaatccaagagactgaagaccttctccacttttccagccccctaggcnatggtgggaggcaagaggcattgatgntcttttctctccctctagggggaagctggaaaacctggtcgtcctggtgagcgtgggcctcctgggcctcaggtgagcagggggctgtggctgaacctgggcttcactgcacttgggcttcatttagaagctgggtccacagtgatgtgttctaatggcccttccttgtcttcttcatctctctccagggtgctcgaggattgcccggaacagctggcctccctggaatgaagggacacagagtgagtcacctttgagtcatttaagtgccccaagtccctagcatacccccatccagtcccagcctctccccaaaagatcctgacgttgcatcatggtgggtggcagctacagaagtcccaagggccagagagtggacatccaaaagcactcctcatggaatcccgattaccgattgggtgagatcttagagccatttggggtttagtctagtggatgtcaaggctgttccaccccctccacaggttcttaccttctacctctttcctgcttagggtttcagtggtttggatggtgccaagggagatgctggtcctgctggtcctaaggtaagaggctgtctgaacatcatggtcctccacatccccgtgttcccaccatgaatgaatttctcactcgttattctctgtttctacagggtgagcctggcagccctggtgaaaatggagctcctggtcagatggtgagtgtgcccagttccagagggcagggatggggcaggaggcaggggcaagatggaggcctgggggaacaaggctgtctcccatctcatctgacttctcttggtttggttgtcagggcccccgtggcctgcctggtgagagaggtcgccctggagcccctggccctgctgtaagtactcctgtggccttgggggatccctgagctctggaaggggctccccaggaactctagggactggccagtgctcagtggacttaacggggcttcccctctctcctgcagggtgctcgtggaaatgatggtgctactggtgctgccgggccccctgtgagtgtggcctgtaggccgtcagggcctgggagtggggaggggtctcagtgtctgctcttggggctgacaatgggggcgaggttatgttggtctgaaccccaggacttcctctgtcccaggtgtgacttgcagctgccatctcttccttctcgctgacatctccattcattcacagggtcccaccggccccgctggtcctcctggcttccctggtgctgttggtgctaaggtgagacccccccactctcctctaagcatgaccctgcatgggccaaggggttcatgtctccctgttccccaaaccaaagggacccagagtggcaagagagcagcccgttcactaacacctttgtcctggggtctccgtctctgatcttagagtcctgatcattgctctcctgtccctgtctccccttcctcctgccatcccgagcggcaaggttggttttcccaggtggtgttgatatgtctctttctttgtgattgagggtgaagctggtccccaagggccccgaggatctgaaggtccccagggtgtcctgggtgagcctggtccccctggccctgctggtgctgctggccctgctgtaagtgtccccgactcagtgtcccctttgccactttctanccaggtccatgtgccaaagggaaaccctggtgctgatggacagcctggtgctaaaggtgccaatgtaagtgcctgccaggcttcagtcccactcctaccgcctgcagcctgcctgccctttccctctgctnctaggctcacgcagtggntgtctgcgtaccgatagggtgctcctggtattgctggtgctccaggtttccctggtgcccgaggcccctctggaccccaaggcccaggcggccctcctggtcccaagggtaacagcgtgagtaccaaactctccttctacccatgcactggctccagctgggctctcatctggggagcaggcaagacgccagagccaactgagcgccccgactctcagcctatcctcttctccccagttgcagggtgaacctggtgctcctggcagcaaaggagacactggtgctaagggagagcctgtaagtctccccggccatccttcttgcagcccagcccaccctgccctaggagcccctgaggaaatccagaaaggaagaggagtcccctagtcttctgggggagtccctgccacacccccagaacccctgacactggaggcccagcctcagccggctctgaggctggcacaggatggcccctcaccacaggccgcctcctcctctcgccctctccagggccctgttggtgttcaaggaccccctggccctgctggagaggaaggaaagcgaggagctcgaggtgaacccggacccactggcctgcccggaccccctggcgagcgtggtggacctggtagccgtggtttccctggcgcagatggtgttgctggtcccaagggtcccgctggtgaacgtggttctcctggccctgctggccccaaaggatctcctggtgaagctggtcgtcccggtgaagctggtctgcctggtgccaagggtctgactggaagccctggcagccctggtcctgatggcaaaactggcccccctggtcccgccggtcaagatggtcgccccggacccccaggcccacctggtgcccgtggtcaggctggtgtgatgggattccctggacctaaaggtgcctgttggaaaagcccggcaaggctggagagcgaggttgttcccggaccccctgggcgctgtcggtcctgctggcaaagatggagaggcttggagctcagggaccccctggccctgctgggtcccctgtgaaaagaggggggaacaaggccctgctggctcccccggattccagggtctccctggtcctgctggtcctccaggtgaagcaggcaaacctggtgaacagggtgttcctggagaccttggcgcccctggcccctctggagcaagaggcggagagaggtttccctggcgagcgtggtgtgcaaggtccccctggtcctgctggtccccgaggggccaacggtgctcccggcaacgatggtgctaagggtgatgctggtgcccctggagctcccggtagccagggcgcccctggccttcagggaatgcctggtgaacgtggtgcagctggtcttccagggcctaagggtgacagaggtgatgctggtcccaaaggtgctgatggctctcctggcaaagatggcgtccgtggtctgaccggccccattggtcctcctggccctgctggtgcccctggtgacaagggtgaaagtggtcccagcggccctgctggtcccactggagctcgtggtgcccccggagaccgtggtgagcctggtccccccggccctgctggctttgctggcccccctggtgctgacggccaacctggtgctaaaggcgaacctggtgatgctggtgctaaaggcgatgctggtccccctggccctgccggaacccgctggaccccctggccccattggtaatgttggtgctcctggagccaaaaggtgcttcgcggcagcgcttggtcccccttggtgcttacttggtttcccttggtgctgctggccgagtcggtcctccttggcccctctggaaatgctggaccccctggccctcctggtcctgctggcaaagaaggcggcaaaggtccccgtggtgagactggccctgctggacgtcctggtgaagttggtccccctggtccccctggccctgctggcgagaaaggatcccctggtgctgatggtcctgctggtgctcctggtactcccgggcctcaaggtattgctggacagcgtggtgtggtcggcctgccctggtcagagaggagagagaggcttccctggtcttcctggcccctctggtgaacctgggcaaacaaggtccctctggagcaagtggtgaacgtggtccccctggttcccatgggcccccctggattggctggaccccctggtgaatctggacgtgagggggctcctggtgccgaaggttcccctggacgagacggttctcctggcgccaagggtgaccgtggtgagaccggccccgctggaccccctggtgctcctggtgctcctggtgcccctggccccgttggccctgctggcaagagtggtgatcgtggtgagactggtcctgctggtcccgccggtcctgtcggccctgttggcgcccgtggccccgccggaaccccaaggcccccgtggtgacaagggtgagacaggcgaacagggcgacagaggcattaaagggtcaccttggcttcttttggccttccagggtccccctggnccctcctggcatctcctggtgaacaaggtccctctggagcctctggtcctgctggtccccgaggtccccctggcttctgctggtgctcctggcaaagatggactcaacggtctccctggccccattgggccccctgggtcctcgcggtcgcactggtgatgctggtcctgttggtccccccggccctcctgggacctccatggtccccttggtcctcccagcgcatggtttcgacttcagcttcctggccccagccacctcaagagaaggcttcacgatggtggccgctaattaacgggctgaatgatgccaatgtggttcgtgaaccggtgaacctcgaaggtggacaccaccctcaagagcctgagccagcagatcgagaacatccggagcccagagggaagcccgcaagaaccccgcccgcacctgccgtgacctcaagaatgtgccactctgactggaagagtggagagtacttggattgaccccaaccaagggcttgcaacctgggatgccatcaaagtctttttgcaacatgggagactggtgagacctgcagtgtaccccacatcagccgcagtgtggccctagaagaatctggtacatcagcagagaaccccaagggacaagaggcatgtctggttcggcaaaaggcatgaccgatggatttccagtttcgagtatgggcggccaggggtttcgaccttgccgatgtggacattcaagctgacctttcttgcgccttgatgtcccacggaggccttcccagaacattcacctaccccctgcaagaacaagccgtgggcctaacttggacccagcagagctgggcaaccctcaagaaaggcccttgctccctccaggggctccaacgaagatcgaagatccggcgcccgaggggcaacaagcccgcttcaccctacagcgttcactgttcgattggcttgccacggagttcacaccgggagcctgggggcaagacaagtgattgaattacaaaaaccaccaagaacttccggcttgccccattcattcgatgtggccccccttgggacgttggtgcccccagacccaggaattcgggcttcgaggttggcctctctgcttctgcttcctggaaaactccctcccatccccaaccctggggtccctcccacccaaccaaactttcccccccaacccgggaaacagacaaggcaacccaaattgaaacccctgtaaaaagccaaaaaatggggagacaatttcacatgggactttgggaaaatattttttttttttgcatttcatctcttcaaacttagttttttatctttggaccaaccgaacatggaccaaaaaccaaaagtggcatttcaaccttaccaaaaaaaaaaaaaaaaaaaaaaagaataaataaataactttttaaaaaaggaagcttggtccacttgcttgaagacccatgcgggggtaagtccctttctgcccgttggcgttaatgaaaccccaatgctgccctttctgctcctttctccacaccccccttgngcacatcccctccactccttcccaaatctgtctccccagaagacacaggaaacaatgtattgtctgcccagcaatcaaaggcaatgcttcaaacacccaagtgggcccccacccttcaggcccgcttcctgcccgcccaggcacccccagggccctgggggacctggggtctctcagacctgccaaagaagccttgccatctggcgcctcccatggctcttgcaacatctccccttcgtttttgagggggtcattgcccgggggagcccaccagcccctcactgggttcgggaggagagtcaggaagggccaagcacgacaaaagcagaaacatcgggatttgggggaacgcgtgtcaatcccttgtgccgcagggctgggtgggagagactgttctgttctgttccttgtgtaactgtgttgctgaaagactacctcgttcttgtcttgatgtgtcacccggggcaactgcctgggggcggggatgggggcagggtggaagcggctccccatttttataccaaaggtgctacatctatgtgatgggtggggtggggagggaatcactggtgctatagaaattgagatgcccccccaggccagcaaatgttcctttttgttcaaagtctatttttattccttggatatttttctttcttttttttttttttttgtggatgggggacttgtgaaatttttctaaaaggtgcttatttaacatgggaggagagcgtgtgcggctccagcccagcccgctgcttcacttttccaccctctctccacctgcctctgggtttctcaggcctctgctcttccgacctctctcctctggaaaccctcctccaaaagctgcagcccaatcctcccggctccctcctaagtctggtcctggggtcctctgtccccgggttttcagacgacaactttcccaaaagcacaaaagaagtttttccccctaggggtggggagggaagcaaaagactctgtgacctattttgtatgtgtatgaatgaattttgaggatgtttttgaattatttttggatttgctgggaataaagcatgtggggaaatgacccaaaaaaaaaaaaaaaaaaaaaaaaaaaaaaaaaaaaaaaaaaaaaaaaaaaaaaaaaaaaaaaaaaaaaaaaaa

SEQ ID NO: 3899 - DNA, 699 bp, Homo sapiens
ttttttttttttggttttgtcttatattttattgagtattcaaagcagacatttccttaaaatttcctctctgtagggggggcgctgtggctcacccctgtaatcacaacactttgaaaggtctaggggggcaaatcacaagggcaggagtttgaaaccagcctggccaacatggggaaacatctgcctctgcctcccaaagtgctgggattggaaggcacgagccaccatgcctggccacaaatctgaatgattttcagtttgaaaataaaatataaaaactgttcttggaattatttataaacagaactaacatcagaatcatctgaatcatcagaatagtctattctggaaaaatcagattcatcaaatgaatctttggccaacaactgttggagaatgatgttagtatcatgtgtaggaatgctatgttttctaggatttgatattttcagccatggacaattactgtattttgtaaatggaaatcccgctactaaaaacacaatgctataaatagaatgatgccttttgtttccaaagtggatatactagagtgatgcgaaaataataataaagtgagatatttcatggcaaagttatcttcgggaagatgctgcagctgcaggtgccaccggtgagtcttctctgggcaaacgagaaaaggatgaagtaaatcacattacacattattcctaa

SEQ ID NO: 3900 - DNA, 498 bp, Homo sapiens
ttttttttttaatttataaagaaaggaagtttaattgactcacagttctgcattgctagggaggcctcaggaaacttacaatcatggcggaaggcgaaggagaagcaggcaccttcttcacaaggtggcaggagagacagcacaggagaaatgccagacacttatcaaacaaccagatctcgtgagaactccctcactatcatgcgaaccaatccaatcacctcccaccaggtccctccctcgacatccagggattacaacttgagatgagatttgagtggggacacagagccaaaccatatcatctgtggccatagcatctgcacttggcttctccccagggagacatacttgcaggtgtccctgtaatgtctcttaatgtgtctaagtaccacgtccacagtttgttagccagcctcttgctcaggaagctccatgccctgtgttacacctgctctgagtctcattagaatccttagaattagggagcagcacccc

SEQ ID NO: 3901 - DNA, 614 bp, Homo sapiens
  misc_feature (1)...(614): n = A,T,C or G
agccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgactttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccagggtaagtctcgaactcctgacctcaggtgatccacctgccttggncttcccaaagcactggggattacaagcatgagccactgttgcccagcctgtttccactgaacatttnttaggacattcagcaaaacccccacctta

SEQ ID NO: 3902 - DNA, 420 bp, Homo sapiens
  misc_feature (1)...(420): n = A,T,C or G
tttaaacaaccctttaaaaatgtaaaatcatttttttagttcatgaattgtacaaacagagggcccgggctagatctggcccatggcacaggtttattgacccctgctctgaattctggttgtaccccagtgccagctacaccactgccccccaaagatgtcctgctgtcttgccatgtctgtcctcgcacacacattacccccccccccgcccccaccaaaacgcctccttcaccctgggagctcagggccctcccctctctttctcttttgacccccagaggccccacggttcaccagggtaggggtgggggcgggggtnggagtgggagtgtgcgtganatgtgcatgtgcctgtgtctacaggggtgtgcgggtgcgccttgtgtgcgggtttgncatgtgtgtgtgttgcgcatg

SEQ ID NO: 3903 - DNA, 712 bp, Homo sapiens
  misc_feature (1)...(712): n = A,T,C or G
nctaggtcttgctctgttgcctgactgcagtgcatggtttcaattatggctcactgaagccttgtattcctgggctcaagcgagtctcctgccttagcctcctgagtagttgggactagagacatgtgtcaccacacccagctaattttaaaaattttttgtagagatggggtcttgctatgttgcccaggctgatcttgaactcctgggctcaagtgatcctccagcctcctgaagtgccgggatcacaggcaggagccactgcatttggctgcattttaaaaaaatatattgcccaaaggcatacaatagaaggtctactgttacttactggaacaaaattgagggtgggtataaataaacggacagagccaatttccctttaaaaatccagacagggccatgacacatgtaaggaggttttaacttgaaaagaagtcaacattgctcctaatcctaatcactgcttgatgctttaaaataagtatcaaaatgtacagaaatgaaaggtcttaaagctacttttgacaaaataatttctgtagatcaggttgagcaatataaccatgtgagtaaagacacaaagccaaaacttcagttctgttttccaaaactgcacatctaagcagaaagcgacgagaagtcaagagttttcaaaaaaaagatgtgtaagctcttttcagtcataaccttaactgggcatttcatcttt

SEQ ID NO: 3904 - DNA, 2375 bp, Homo sapiens
cgggtaggactgctgtgattaggacggatcagacgaagaggggcgtttggtattgggttatggcagggggttttatgttgataattgttgtgagttatattaatttttatcaatgtgattagatacatattttggcctattaatcttattcattatattcttagtctgagatgggttttaattctgactaacagcagctacttaagagtccaatcatacaaaatcaggagagtattaccctttctacagctaagcgagtcagtaatacagcagcaactaatactggccattaataacgtccagagagcacattagcaaaccttgtactcccagtgactgtcaggagacttgaaaataactactattctcttccaaagtagaatagcgtttttctagatagtgaaggaaatgatagtcatagttggtctgaactccaagatcctactcctcaaaacagcaccgaagcaggggttcgggatgcctgctaagagcatttccacagttcaagtctcttcagaaccttagggaccttcgtgtctagcttcacacacccacctccacatatgaaccagcctaccacacttcacatctgggtacactggccattagcaacaatgcagtctcatgcagcagcacattaaaatcaaacgggtggcaatcgttcaccaccctcagagtgttgggagactttcacatttcatcatccttataatccacaaacagaaacatgaagggatgcaagtgagttcagcattcactcgtttggtgcactcaagtgctgagagaatgcagaatttacagtgtcacagaggaaaaaagccatctgaaataattgtaaaaatggttaagtgtggtatttaaatgttggttccctcctcttcatacaagtggaagaaaaggaggggctagggtacccactgggccatgaggttaaccccttagcacaggcaatgaagaacatccaatgccacagattctgcaggaggagaaatcccaagggtatacagtattcctgagaaagatcccagatttttctgaatcagtcttaatctgattttgttttggctacacagttatgctgttatacctttgacatacataaaaatggtcattttatttcaatccagacagctcagcattgtacaaatgatggcagaaagatccatttgttcagactcagcttgctttgtttttaatactggggaataaaccaaaaaaaaaagtgtaatttttatcatttgtatccttcattctactttactggagtggaatccccagggccttcagataatctgggaagacctgactattcctgtgaggcaagcacagccctgctgagctttactcagaataatgcatgatagactcaacgtaattcccaggaaaaagcccagtcactccattcataactccctcataccaaccatcgtcattcttcttgatgacataaataatggctccttcctgaaaggacagctcatcttccttgtcttttgtatagtcataaattgccacaaccttttccaagtaagaacgtggagcccacggtgggtcctcttcagcataaggatcactatactcaaccacagcagcttcctcctcttcgtaatcttctggaggaggaggaggtgggggagactcatcaaagactggttcttccacaggtggcggtggaggtggtgtatctgaaactggattctggctataaaaaggtcctccattcatctgattctgaaggcttgtttgtgaagtaatggaaggagggcgtctatagggcaacgagccccctattgttgggggagtatggcgagaggcaggcctattcatgctgtagaactgtacaggatgacctgtagggggagtggaagaaacaacagggggagttggagaagtgaagccatcagcaagggtctgggcacccccagcagcagcgtctggggcagtggaggaagggacagtagcaggaacaagaggagcaggggcagatgcagaagtagcaggaaggggaggagtgccagcagagcacgcaggggctggaaagacactgggaggagatggagtaggaacagcaataggaacccccacactaccacttccactgttctctcgactgctgctccgactacttgggtggctccctccactactcccactgctgccaagtgtccctttccctgacatagggggactagggggcttctgagttggaggtgttgtacgcggcagcccacccatcttcatgttctgggtactcaccttaaatctaagcaaccacgttctcctgatcaaatatcactctcctacttacaggactcaacatactagtcacagccctatactccctctacatatttaccacaacacaatggggcccg

SEQ ID NO: 3905 - DNA, 1515 bp, Homo sapiens
tttttttttttttttttttttttttttttgagacaggggctcactctgccactgaggctgcagcacagtggcatgatcacggctcactgcagcctcaacctcctgggctcaggtgatcctcctgtctcagcctcgcaagtagctgggactacaggtgcatgccaccacacccagcttatttttgtatttttcgtagagacagggcttcaccatgttgcccaggctggtctcaaactcctgggctcaagtgatctgcccgctttggtctctcaaaatccccactttgggaattacaggcatgagccaacacacctggcctgaagctcaatattcttataagttttatagaattttataatctacacagcttaaaaaggatagttggagttaaactgtaatataaaagactatatacattttctgaaagaaaaggaattaaaattagactgcaatttacaataaactatgaacttgggctaggattttacctcaaatttaaaattcactagaaaaacaatttctaaacaaatctttctgaagtataaaaatgtgtttcccaagagaagaggaagttatacacacaaacaacaatcctacaaagaaaatgttctctcttcaaatattcaaaaaataatttaaatatgttgtgcttcatttttaaacaatactacatgaaatggttttcaattactacttatatactcacccaagtgtccctttccctgacatagggggactagggggcttctgagttggaggtgttgtacgcggcagcccacccatcttcatgttctgggtactcacctaaaaaattttaaggaaaactcaacttgtatgcagtgaaataaagtggcacttttgggaaataatatgctacactacataacaaaggaggggaaggtttaaataaagggaaaaaaattagaggccatgcatttcatatgcaatctctactctactattactctacagttgtactcaaaggactcttcctaacatgagattttcaaatcattataaacttgtatgcaaagactttatttgccattaggccatcacaccaacagatcactggttagattatttgatattacattcaattaaaattaaatagaataactacaaaattttagttttaataaggagtaactcaatcaaaaacaataatgccattaggccatcacaccaacagatcactggttagattatttgatattacattcaattaaaattaaatagaataactacaaaattttagttttaataagagtaactcaatcaaaaacaataatgcttttaagcaattccttatttttagagataactttctttttttttttctgagacagagtctcgctttgttacccaggctggagtgcaggggcacgatcttggcacactgcaacctctgcctcccaggttcaagcaattctcctggaggcaagagaattgcctgggcacagaaggcagaggctgcagtgagccaatattgtacaaccgcactccagtgagact

SEQ ID NO: 3906 - DNA, 1631 bp, Homo sapiens
tttgttcagactcagcttgctttgtttttaatactggggaataaaccaaaaaaaaaagtgtaatttttatcatttgtatccttcattctactttactggagtggaatccccagggccttcagataatctgggaagacctgactattcctgtgaggcaagcacagccctgctgagctttactcagaataatgcatgatagactcaacgtaattcccaggaaaaagcccagtcactcctttctgatcccccgcttccctcccgtcgtcattcttcttgatgacataaataatggctccttcctgaaaggacagctcatcttccttgtcttttgtatagtcataaattgccacaaccttttccaagtaagaacgtggagcccacggtgggtcctcttcagcataaggatcactatactcaaccacagcagcttcctcctcttcgtaatcttctggaggaggaggaggtgggggagactcatcaaagactggttcttccacaggtggcggtggaggtggtgtatctgaaactggattctggctataaaaaggtcctccattcatctgattctgaaggcttgtttgtgaagtaatggaaggagggcgtctatagggcaacgagccccctattgttgggggagtatggcgagaggcaggcctattcatgctgtagaactgtacaggatgacctggaaagacactgggaggagatggagtaggaacagcaataggaacccccacactaccacttccactgttctctcgactgctgctccgactacttgggtggctccctccactactcccactgctgccgtaagttcgatttctttgattcacagaagctgtcctcacagggctctgctgcgagggagccatattacgggttgggctaggtacgtaatcatttggtaccactggaggacgcactggctccagtgtgcgatagggggagtgccgcccaagtgtccctttccctgacatagggggactagggggcttctgagttggaggtgttgtacgcggcagcccacccatcttcatgttctgggtactcacctttactccatgtccaatatcatctagaattgtatagtcaataggttttctaatataacgaactggtcgttcaaggttggctggagcaataatcttatgtgtccttgaagtgtttttattggtagtcaaaataccaatttctcttcttgcaactttctctttatgaatatcaactgtctcattcaatctcaaactgcaattgtttccaaatttggtcacaaaagtcgactcaagatcaacgcctctaatttgcttgtgaaatatgattgattgaagattccatccttcgtagctgggatgcctggatatccagcatctgcaggacattgttggccaaggtgtttatcagataggcaacacttgctaaggattgggtggtgtaggctttggtttcttctagggctctctgcttatctgctgactgtatgtagttgttctcgcagtaatcggccacccgttccagatttgtgtagctgtcgaatgcagcccggcggccccccgggatttcctcttccagcagcatctgcagctccgccatcctcacatcctcctcctcctcctcctcatacaggtcgc

SEQ ID NO: 3907 - DNA, 1742 bp, Homo sapiens
tttttttacataaaaatggtcattttatttcaatccagacagctcagcattgtacaaatgatggcagaaagatccatttgttcagactcagcttgctttgtttttaatactggggaataaaccaaaaaaaaaagtgtaatttttatcatttgtatccttcattctactttactggagtggaatccccagggccttcagataatctgggaagacctgactattcctgtgaggcaagcacagccctgctgagctttactcagaataatgcatgatagactcaacgtaattcccaggaaaaagcccagtcactccattcataactccctcataccaaccatcgtcattcttcttgatgacataaataatggctccttcctgaaaggacagctcatcttccttgtcttttgtatagtcataaattgccacaaccttttccaagtaagaacgtggagcccacggtgggtcctcttcagcataaggatcactatactcaaccacagcagcttcctcctcttcgtaatcttctggaggaggaggaggtgggggagactcatcaaagactggttcttccacaggtggcggtggaggtggtgtatctgaaatattttcttggactctggccacaaatcccattaaaggtaactgaggagttacctgtaggatggagggaggaggaggagcaagagatactggattctggctataaaaaggtcctccattcatctgattctgaaggcttgtttgtgaagtaatggaaggagggcgtctatagggcaacgagccccctattgttgggggagtatggcgagaggcaggcctattcatgctgtagaactgtacaggatgacctggaaagacactgggaggagatggagtaggaacagcaataggaacccccacactaccacttccactgttctctcgactgctgctccgactacttgggtggctccctccactactcccactggtgctgtaagttcgatttctttgattcacagaagctgtcctcacagggctctgctgcgagggagccatattacgggttgggctaggtacgtaatcatttggtaccactggaggacgcactggctccagtgtgcgatagggggagtgccgcccaagtgtccctttccctgacatagggggactagggggcttctgagttggaggtgttgtacgcggcagcccacccatcttcatgttctgggtactcaccttcacctttactccatgtccaatatcatctagaattgtatagtcaataggttttctaatataacgaactggtcgttcaaggttggctggagcaataatcttatgtgtccttgaagtgtttttattggtagtcaaaataccaatttctcttcttgcaactttctctttatgaatatcaactgtttgtgaaatatgattgattgaagattccatccttcgtagctgggatgcctggatatccagcatctgcaggacattgttggccaaggtgtttatcagataggcaacacttgctaaggattgggtggtgtaggctttggtttcttctagggctctctgcttatctgctgactgtatgtagttgttctcgcagtaatcggccacccgttccagatttgtgtagctgtcgaagagggcccggcggccccccgggatttcctcttccagcagcatctgcagctccgccatcttcacatcctcctcctcctcctcctcatacaggtcgcagagggagcggcggccgc

SEQ ID NO: 3908 - DNA, 1096 bp, Homo sapiens
  misc_feature (1)...(1096): n = A,T,C or G
ttttttttttttttttttacataaaaatgggcattttatttcaatccagacagctcagcattgtacaaatgatggcagaaagatccatttgttcagactcagcttgctttgtttttaatacatcgtcattcttcttgatgacataaataatggctccttcctgaaaggacagctcatcttccttgtcttttgtatagtcataaattgccacaaccttttccaagtaagaacgtggagcccacggtgggtcctcttcagcataaggatcactatactcaaccacagcagcttcctcctcttcgtaatcttctggaggaggaggaggtgggggagactcatcaaagactggttcttccacaggtggcggtggaggtggtgtatctgaaatattttcttggactctggccacaaatcccattaaaggtaactgaggaggtacctgtaagatgggagggaggaggaggagcaagagatactggatttctgctataaaaaggtcctccattcatctgattctgaaggcttgtttgtgaagtaatggaaggagggcgtctatagggcaacgagccccctattgttgggggagtatggcgagaggcaggcctattcatgctgtngaactgacaggatgacctgagagctagcaccatgactcaaccctggaaagacactgggaggagatggagtaggaaacagcattaggaacccccacactaccacttccactggtctctcgactgctggctccgactacttgggtggctccctccactactcccactgctgctaaagaaataagagccaccaaaacatgagtatttataaacagtaagagatcatcagcacttcccgacattttctgagatgaatgtagctacaataaaggtaattcaaaagcgtaccacttcaaaataaaatttccttgagctccaagtcagtgacaggttaaaaaaaaatgtgtgtgtgtgtgtgtgtgtgtgtgtgtgtgtgtgtgtgtgtgtatatatatatatatatatatatttacntatttataaagttggaggggaaaactgagttcantaaggttgttttgaccacttttgaaaaattattc

SEQ ID NO: 3909 - DNA, 406 bp, Homo sapiens
  misc_feature (1)...(406): n = A,T,C or G
cacacgcaccacgccgagaactgcttccaccgctttnttaaaggtttttaaaatgcagtttctccagccggagctcaacccattttcaccagccncagccctcaccaagctccccacccccatcgggggctccgctgggccgtgtccccgaggcggcctcggccccacgccccgaggcgcgcggcccccggcgggggggtccccgacgcggcccagctggggatgcttcgcacctgtatgtagttgttctcgcagtaatcggccacccgttccagatttgtgtagctgtcgaagagggcccggcggccccccgggatttcctcttccagcagcatctgcagctccgccatcttcacatcctcctcctcctcctcctcatacaggtcgcagagggagcggcggccgc

SEQ ID NO: 3910 - DNA, 598 bp, Homo sapiens
  misc_feature (1)...(598): n = A,T,C or G
ataaccatcccacaaaaagacagaatctaaaaacaacctaatattaagttgctattttccaaatcgtacatgtgagttaacttacataataaaagctgccagcattacagatagcctgtgtttattattaagggttcctcataggcaaataggaaaatattgtggtctcacttgtgaaatatgattgattgaagattccatccttccgtaagctggaattgcctggatatccagcatctgcaggacattgttggccaaggtgtttatcagataggcaacacttgctaaggattgggtggtgtaggctttggtttcttctagggctctctgcttatctgctgactgtatgtagttgttctcgcagtaatcggccacccgttccagattggtgtaggctttggtttcttctagggcgctctgcttatctgctgactgtatgtagttgttctcgnagtaatcggccacccgttccagatttgtgtagctgtcgaagagggcccggcggccccccgggatttcctcttccagcagcatctgcnantccgccatcttcacancctcctcctcctcctcctcatgacaggtcgtcagtagggta

SEQ ID NO: 3911 - DNA, 715 bp, Homo sapiens
  misc_feature (1)...(715): n = A,T,C or G
attcggcagagggttaccattctgatgttggaggtgttgtacgcggcagccacccatcttcatgttctgggtactcaccttaaatctaagcaaccactttactccatgtccaatatcatctagaattgtatagtcaataggttttctaatataacgaactggtcgttcaaggttggctggagcaataatcttatgtgtccttgaagtgtttttattggtagtcaaaataccaatttctcttcttgcaactttctctttatgaatatcaactgtttgtgaaatatgattgattgaagattccatccttcgtagctgggatgcctggatatccagcatctgcaggacattgttccccaaggggtctgtcagattaggcaaccacttgctaacgacggggaaaaactttaggctttggcttcttctagggctctctgcttatctgctgactgtatgtaggttgttctcgcagtaatcggccacccgttccagatttgtgtagctgtccgaangacgccggcggcccccgggatttcctcttccagcagcatctgcactccncnatcttnanatcctcctcctcctcnncctcatacaggtcgcagagggagcggcggccgcagcgccaaggaaacccaggaccgggagaggaggagcggcggcgacggcggcggtaactcggaaggagcgagaaacagccccagcgcgcgacagggga

SEQ ID NO: 3912 - DNA, 368 bp, Homo sapiens
catcttcatgttctgggtactcacctttactccatgtccaatatcatctagaattgtatagtcaataggttttctaatataacgaactggtcgttcaaagttggctggagcaataatcttatgtgtccttgaagtgtttttattggtagtcaaaataccaatttctcttcttgcaactttctctttatgaatatcaactgtctgtatgtagttgttctcgcagtaatcggccacccgttccagatttgtgtagctgtcgaagatgccggcggcccccgggatttcctcttccagcagcatctgcacgccgccatcttcacatcctcctcctcctcctcctcatacaggtcgcagagggacggcggccc

SEQ ID NO: 3913 - DNA, 328 bp, Homo sapiens
  misc_feature (1)...(328): n = A,T,C or G
gcttctgaagttgnaggtgttgtacgcgncagcccaacccaatcttcatgntctnggtactcaccttaaaatctaagcaaccactttactccatgtccaatatcatctagaattgtatagtcaataggttttctaatataacgaactggtcgttcaaggttggctggagcaataatcttatgtgtccttgaagtgtttttattggtagtcaaaataccaatttctcttcttgcaactttctctttatgaatatcaactgtctcattcaatctcaaactgcaattgtttccaaatttggtcacaaaagtcgactncaagaacaacgcct

SEQ ID NO: 3914 - DNA, 448 bp, Homo sapiens
gcagaaatcatatctcattatacatcaaagaactcatacagaagaaaaaccctataaatgtaatgaatgtggcaaagcttcagagaaaagtcaaagcctcattatacatcagagaattcatacaggagagaaaccttatgaatgtcctgtgtgttggaaagcttttagccagaagtcacagctcataatacatcagagaacgcacacgggagagaaaccctatgcatgcactgagtgtggcaaagccttccgagaaaagtcaaacattcactgtacatcaaagaactcatactggagagaaaccctataaatgtacagaatgtgggaaagcctttacccaaaaatcaaaccttattgtacatcagcgaaccctagcagggaaagaaagccatggaagaggccacactcggaatcaaagttcatggcacattagagagctaataccacc

SEQ ID NO: 3915 - DNA, 373 bp, Homo sapiens
  misc_feature (1)...(373): n = A,T,C or G
tcacaagtcaatctcccatccaaatgacagtttgtctaagatcattaacttggtttgccaatttttttatctatttgggtctgagaattccacaattttgaagaattcttttgccaattattgacatattctgcagtttgaagacaggagtgtaaagcaattacagcagccacagcagtagctgcgaactgcaataaggcccataatcattgcaatcaaagtaaaaatgaatcttttgggatctagttaggaactccttttaatacttctgttaacatatgggacaggatggggggaaggcctcccacgttcaggtccntggggacacagggaatccacacgccctctcttggccctcactaggcgggatang

SEQ ID NO: 3916 - DNA, 506 bp, Homo sapiens
gatgcttccctgtgtggtcccttgtggcatagagtgccccctcttctcaggaactgtgagtaataaactatctttttagtgatggtcattcctgacctgttgggcttcaccatacctacattatttatttatttatttatttatttatttatttatttatttatttattgtgacagagcaagactccatctcaacaacaaaaaaagaagagattaggacatagacacacacagaaatgaagaccatgtaaagacatggggagaagatggccgtctataaaccagggagagaggcttgagacagatccctcccttatgaccctcagaagaaaccaaccccacccgcaccttgatcttggccttctggcttccagaactgtaagatatgaaattgatgttgtttaaggcactcagtgtgtgagactttgttatggcagccccagcaaacgaatacagagggggcctgcttccgatcccagcctgggtgacagagcaagactccatctc

SEQ ID NO: 3917 - DNA, 466 bp, Homo sapiens
  misc_feature (1)...(466): n = A,T,C or G
tcttgttacccaggctggagtgcagtggtgtgatctcggcccactgcaacctctgcctcctgggttcaagtgattctcctgcctcagcctcccaagtaactgggattgcaggcctgtgccaccatgcctggctaattttgtatttttaatggagacgaggtttctccatgttgttcaggctggtcttgaactcccgacctcaggtgatctgcccatctcggcctgccaaagtgctggggattacaggtgtgagccactgcgccagggcccatcattctcttttatgggctgaatattattctgttgaatgcttatacagtattttatttgtccatttatcagtgaatggggacgtggggttgtttgcacatttcaggtatggaataatggctggnataaatatggacatncaggtacaagttttgcnggggtttngtttnaattatctnggggnaaaanacccggg

SEQ ID NO: 3918 - DNA, 793 bp, Homo sapiens
  misc_feature (1)...(793): n = A,T,C or G
tactactaaacttagcggccgctcgaaaaaacggcggtagttggtgtgtcctcggtttctcggctgctgggtcggtcccgcccacagctggggcgccctatgtcgagtggcgcccatggaagagggctcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttaaaaaaataaaaaaaaaaacctnggngggggggcccggttcccaantttggccttatangtgngtcggtntnacaatttaattngccnntngttttaaaacgtngntggcttggnaaaccnnttgggnttaccnaactttaatttggnttttaagnaantccccnttttggcaatnttggggnaattggggnnggggcctnaaccngtttngcatttccaaaaantttggnacnttnattttc

SEQ ID NO: 3919 - DNA, 1110 bp, Homo sapiens
cccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcacccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctaaccttctttacttgtatcaaatgatgactggtatactggtctcccatccctttgcttgtggcaggagatggcttaaataaataacttaaatttagattggtcatgagctgagagttactttctttggttgtgtttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattactccttggtcaggtgcggtggctcatgcctgtaatcccagcactttgggaggctgaggctggcagatcacctgaggtcaggagttggagatcagccgggccaacatgatgaaatcctgtctctactaaaaatacaaaaatagt

SEQ ID NO: 3920 - DNA, 409 bp, Homo sapiens
  misc_feature (1)...(409): n = A,T,C or G
ccacggagagcacgagagacccganttcatcgcctacccccatctccgcatcaggaccaagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaacttaaaaaaaaaaaaaaaaaaaaaaaaaaaaaaaaaaaaaaaaaaaaaaaaaaaaaaaaaaaaaactnggggccg

SEQ ID NO: 3921 - DNA, 722 bp, Homo sapiens
  misc_feature (1)...(722): n = A,T,C or G
ccttccttccttccttttctttctttctttctttctttctttctttctttctttctttctttctttttctctctctctctctttctttttctttttttttttttttgagacagggtttcactgtgctgcccaggctcggagtgcagcggcgcnttcatggcacactgcagtctcaagcgctcaggctcaggtaattctgagcctcccgagtagctgggattataggcgcacaccaccacacatggctaatttttgtattttttgtattgacggggtttgccatgttgaccaggctggtcgtgaactcccagactcaagttatctgcttgtctcagcctcccaaacaaagtgttggaattgcaggcgtgaccaccgccgcctgaccctcagttttttcatcagcctaaagaagctttatttgtttaccatcctactgaacatccgctgtgtgcctggcaccttttctaggttccgggaacataacccaaagaagacagataaggttacgactctcaggggttcacgttctcatgcgtgtaggtgggggagtgggagacattaacaaggaaacaagctcgggaacccattaatttccagattgtgggcagaggctntgaaggaaaaccgtgcaggctgggggcagcagggtggggctttctncagggggntccaggggttccacaggggccttcccctagagggagacttttttgagctnagct

SEQ ID NO: 3922 - DNA, 434 bp, Homo sapiens
  misc_feature (1)...(434): n = A,T,C or G
gcccccctgccgtggccccttggccccgggcgcgcccggcggggtccatagtctcctccgcgggccctgagcgcagggccagacccagactcggacccagatccagacccagactcggacacagatccagacccaggcaggcccagggcgcgggggctggacgcaggcaggtcagcccggccggagcgcaggatcnagtccgctctctgttgtggcggttcntngggcaacaagcccctaagtttccagccctgccctgacttgggctggcctgggataatccgccctcaggtgtggcgtgcacagtgctaaggtttggttctctggaaaataaaacatccagcgaccatcgagaacgggccatgatgacaatggcggttttgtcgaatagaaaagggggaaatgtggggaaaagagagaganatcagattgtt

SEQ ID NO: 3923 - DNA, 1466 bp, Homo sapiens
tttttttttttttttttttttttttttttttatttcaatccaaatggttatttattctaaaactggaagctactttgcctacattttcgccagaatggtgtaatgagaacaggggaggaaaaagttacagatgtaaacaatgacacagttacattttttttttaaatggtaaaacccctttttactggccacttccaagaatgctttacaggttgtgcaaaaacatttacaggctccatgtggtgtttttctcacaagctttcctgtctacaactacaacagacgtctgataaaacactaaacaagtcttctaaggaaaacaaggctagggattcctctggttaccataatccacattttcccccttaacatagtttttcataataaaaagacagaaacaaaacccggacatctactgttgttgcaaatgatctcttggactaaaccaacaaggatgtggcagtttcactttccacccacctagaaaaacagttttgtaaaaaagattactttctagtgtcaaatatcaacagcgagtacctcccctaacccctgctggaaaaaaactcaacttgatttagtttagtccccttgcccctaagggccctagcatccccatccatgtcacagactacaagaaagatgctatttgcaggactaaacatctgaaaaggggtggcagccactgcctcaggaaattcaattttctattataacataatcttgccctaagggaatttctttgggctccagtttttacatgtggggattacaatttgagatgagatttgggtagggacacagccaaaccctgttatcccagcactttggaaggctgaggcgggaggattgcttgagttgaagaatttgagaccagcctgggcaatatggcaagatatcatctttatattaataataataataataataataataaaagcagaaatcaattaaaaaaacaaagccaaaagttgattctttgaggcataaaaaaactgtcaaaatagaaaactactgacaagactgatcaagatagaaataaatattaatgaaaaaggtttaatgtgacatataaagtataaagacataattaaaacttagattggagggacaaattcttagaaaaatataacaagaactaactctagctgggcacagtggctcatgcttataatcccagcactttggaaagccaaggcagttggattgcttaagcccatgagttcaagaccaacctgggcaacagcaagaccctgtctctacaaaaaaaaaatttttttaattagccatgtgtagtcccacctgtagtacacatgtgtggtgcacacctgtagtcccagctactcaggaggctgaggcaggagggttacttgggcccaggaagtcgaggctgcagtgagccatgattactactgcataccagcctgggtgacagagcggaccctgtctcccaacaaaaaaaaaaa

SEQ ID NO: 3924 - DNA, 1148 bp, Homo sapiens
  misc_feature (1)...(1148): n = A,T,C or G
tctctggtccataatcacatttccccttaacatagtttcatataaaagcagaacaaacccgncatctactgtgtgaaatntctcttgnctaaccaacaagntgtggcagttcactttccacccacctagaaaacagtttgaaaaaagttactttctagtgtcaaatatcaacagcganacctcccctaacccctgctggaaaaaaactcaacttgatttagtttagtccccttnccctaagggccctagcatccccatccatgtcacagactacaagaaagatgctatttgcaggactaaacatctgaaaaggggtggcagccactgcctcaggaaattcaattttctattataacataatcttgccctaagggaatttctttgggctccagtttttacctccttgccttgacattataagcaaagctttctcaaactcccttaataataatacaaagttaatgtgttacagaaaaattcatgcaatcactccactgccacacagaaatccatttgaggacaccgcagggaagcaggtgccaagagaaaggacatgactatgagtaagcaaacttatctcctaccagccccattccagccttggggtcagaggtatttgggcggaagggtgtgtcatgacagacaaggacactagaggccagaataagggtctgtacacctgaacaagggctgcaggcagtaaagtgggaggaggagaggaagaccaaatcagcccacaattttaaacagagaactgcccaggtgaggaaatggaagtgaagcattttctgtggcacagattttctcactaggaactgctgcagtatgtggtgtctgctgagtaagctcttggctgacagtgctgagcaggaggatgaatgaaaactgaagctagacattgaaagagcattccatatcccacccatattcttgaacccagcaacctacagctgtctatcaagaactgggagggtattggtaaagtcacaaatgaaactatcccaactgaaggctcctggctagaggcctctctggggacacacagggaaagcgccccaaaaggaattttgtttctagaagtcgggaaggggtgctccctttcacacgcacatttacacacgttcacactcacactcttcccaaggttc

SEQ ID NO: 3925 - DNA, 1406 bp, Homo sapiens
  misc_feature (1)...(1406): n = A,T,C or G
ttttttttttatttataaaaaatgcctttatatattgaaatatataaatatatataaacacacacacacacacacacacacacacacacatatatatatatatatataattgcctttatatttaggcggtatgagttctccctaagcgtgagttggctctgccctgcacaggcacccaaacagtcctacctaatgtcacttcaccaggaaatgagaggacatggtacagtgtgggagacagcactaacacgtgctgaataactactgtgtaccaggcactgtgctcggtgcttgttactgttaactcatttaacccccacaactcatctacaaagttggcattaaaatccccaagtcactcagtgagccatgggacctgaatccgaacctagtttatctggagccataatctgggctcctcccatttttccatactgctttccaaaagcattgcggttcactctttggatggaaccagtcccgttccgtatgctgtgatctatccctgccgtggaattcctccgaggctccaactccgcagccggagaagctgctctctggcctccgcgggcagagctctgcttatgacttcgtcttccagaggtccacatttctccccttgacgccccctgtctaccacctccacctggaaatttgatctttactgtgctcagtgatcacgaaattggtcaagcctattcatgttccttctcatctagaattctgtgtgattgttttagcataaactgccccgctcccactgtatcatttcacgatctccttttaatgtttttctttcagttttgcactgacagtctggtgacaggtgctgccagggtgcaagttacattgcaatgttctaaaccttttgaagtgttcttagcaaaagcctttctttctgggtgtttttgtcgaatgagtctatgaagactcaatgcatccatcttgggctgatcatgccacagatctcattccagctatagtactgccaagaagtgaagtttatcattgaattttacctgtgttgctctcttttaaagtaatgactttgagatgcatgctttgtatcatattgaaaagtatgttttattttccttaaagttgtaatattgtgtgtgaaactgtacatattttaaatgatgtagctttggcaggttttatttggttgatatgattttatattaaaagagaaggctgctttcatatagcatagcccctgaaggtggggaatactccctgtttgtacaacggctgcttattagtttgtggattgggggtgggccgaatgtcttcctctggaantctttggggaaccccccacccctgtccctcccctggaaacntcccctgtggcaaaaccctcngttcctggactgcaggagatccaagggccntgaagggagcag

SEQ ID NO: 3926 - DNA, 705 bp, Homo sapiens
  misc_feature (1)...(705): n = A,T,C or G
gagagagaatgagtgcccagcgaagggagaagctccttataaaaccatctgttctccttataaagatctcttaataaaaccgtcagagaactatctcattcactatcaggagaagagcatgggggaacgcccccatgattcagtttactccacctggtcccgcccttgacatgtgggtgttattacaatttaaggtgagatttgggtggggacacagagccaaaccatatcacaaggctttctcctccttgctgggattgtacccatagcctctttctgagtcctctctcttttagcctctttatgcctgcagtgcatccttataccatttctagagtcatctttataaaacttatactctccgtatgactcataaatcctgttttntttttgcacagtatattaagtataaaatttgttaaagtctttaatggtctgcccccaagctacatttccattttgtatgtctttcagttcctttctactttgtattttggctggttgagttaactgaatttttgccattccattaacccatcccatgcttttcccacttctagatttcacttttcttgtaggctagaatgtcttgactgggatctgactggagataatgagaacaaaaactggttcaaagagccagggatgttgcataaaagtcctaagattgtatctaaggcaggtaaaatgaaaaatttttttttt

SEQ ID NO: 3927 - DNA, 791 bp, Homo sapiens
gtcctaactattcagattccttgagcccaggagtttgagtccagcctggacaacatattgagacccccatctctctaaaaaaaaagagaaagaaagaaggaaagaaaaaaagaaagaaagaaagaaagaaagaaagaaagaaagaaagaaagaaagaaagaaagaaagaaggaaagaaggaaagaaggaaagaaagaaagagaaagaaagaaaagaagattgtagctagggggagagtaggtgaaaagatgaacaacatgaccgggaagatttcctaatctcaccacagcctggctctaccttaagtctttaataaaagcttgactgaaggtaccaaggtgtgctgaagtggaagcaaagttctccaaagtccagcatggtagacatcagtggtggtaaccaaggacagaccccaaggcaaggtgaacctcaaaaatggaacctcaagtctatgcagtccagctgccctccccaccagaaagtccttgttccagcccaacatcagtgcctctgagtttgtttactagaaacaaaggaagaatttccttgtaaaaatatagacagagtagtccctggctttctcctcttgcaggaaggatggattctcccattccataccatctttcccccacactggccccagaaatacttaattcaactatgtgaaaataaagattgtttttggtttgagggcatagggatccatttatccttattctttatgaggcactaaattagctttgtatgttattaaatgtgtctcgtcaatgctgttggcattgtttcatttt

SEQ ID NO: 3928 - DNA, 810 bp, Homo sapiens
ttttttatttatttatttatttatttatttatttatttatttatttatttattttttgagagatgtagcctccctatgttgcccagattggtcttgaactcctgggctcaagcaatcctcctgcctcggcctcccaaagggctcgggattacaggcgtgatccaccgcttctggccaaaagagggctatagggcacccccagaacgcgagatctccctcgtctgtcatctttacagaggaggaagtggactcccaatccagccatagtccattcgccccgggcacggtgactccggggcggccagaaccaaatgtgtctcctggcttttgcacggcatcaagtaacccgcgccaggccgcacagctgccctggccttcagcaaggactccgcgagcgaggtgcaagctgctggggagtgccacagcaggagctgaggcagcggattccgagggcggggtggggctgaatcgggaaggaacgcggaacccggtggaaacgcactgcgcagacggcgccggcgccagcacttcggccgttgacgagtctttcttccagctgtcccctgcaagtcgtccaggcggcggtccctttttttctgcctttttgtttcctccggcggctcggcgcgagggtgaatttccgtttccggcggtgtccaagcggacctaaggagtcgcagttgtgaacaggtttggtgccgcgggctggggtaggcggcggttgggtccgtggctctggggcactgggaagatcgcgagtcgtgcgcatgggaaggtcctcccccggtctccgggtcatctgttgtcccg

SEQ ID NO: 3929 - DNA, 479 bp, Homo sapiens
  misc_feature (1)...(479): n = A,T,C or G
gtggaggttgcagtcaactgagattgagccactgcactgtactccagcctgggcggcagagctagattctgtctcaaaaattaaataaataaataagtaagtaaataaataaataaataaatgtataaagcactatgttaggagattgaaggaaaaatatgaaggttctagtattcacaagctgtcctgtgataagagagatttgatcttttctgtagatggggtgagactaggattaaatttcaaaatttgagaaaaatattttcattccatttatgggagaactttctagcagctacactttctccaaaagggaacaagctactgtggagtggggggtagttcttcctcctctgcttagaggagaatttttggagagctctcagactttacataggtgattggactggctgacttctcaggtcttcccagtatttgaggtctgattctgggctacataccctactcctagnagcatt

SEQ ID NO: 3930 - DNA, 435 bp, Homo sapiens
  misc_feature (1)...(435): n = A,T,C or G
cagagagtgcccgtggaagcgagacctcnaanatgtgagacacacaccgagagcttcaagaactcggaaatcctgaaacctcacagagcaaaaccatatgcatgtaatgaatgtggcaaagcttcagttactgttcttccctttctcagcatcagaagagccacactggagagaagccctatgagtgcagtgaatgtgggaaggccttcagccaggagctcatctctcattcagcaccagaggattcacactggagagaagccttacaagtgcagtgaatgtgggaagagcctttcagccaggaatgccaacctcaccaaacaccaggcgaacccacacccggaggaggaagcccttacaggttgcagcgagtgttgaggaaagcctttcagttgacttgtttcagntttttgttttccaggcnttcaggagatt

SEQ ID NO: 3931 - DNA, 2045 bp, Homo sapiens
gcccccccttttttttttttttttttttttaagttaattgttactttattgtagaggaaaaatatcctgaaatatttattaaataacaataattcctgacaaaatcattcttcgggatgtgttagccaaacaatctggtcaaatggagtaagctgtccctcaccccagtaataagctccattcatattgccataaaccacaggaaaatccaaaagattttctaaatggcttccaaatttctgcacagatgcccttattgagcccagaggtaaatataaacaaattgaaattagagagaaattagaaggatagctgagaggaaaaaaatgttaacaattggtgaatccagaaggaagggtatatgggggttcattataccattctttcttaatttctgagctacttaatttctgagtaacttaatttctgagttacagttgcttttgggtgaccatgttctctttctgacttgcctaaaaaatatgttcagttatttcttttcaaacctgaaatacaaaatcagctctttctcaggtgatgcccccctttctactatctacaaaaacttccaaagctttctagaaagcttaaattaaggggctacagtacactgatatggttttgttgttcttggaaggtgttggactcaaacgctcatcgaaggtctgtgatggtcactgctctgtccacaacagtcacgtggctgcagctacagaacagaggtggatccttgctgtgtggatgaaatcctttctggcgacaggaagaaatctcctctagtccatggtcagttagtttaaagaatccagtttcctggaacttgggggagcaaacaatggctactgactctggcaacatcatctggtaagagcagtgagtgtgtaggtcgacactggagagaaacgcggtctgtgtggggtgagtatgaatccagcccagtgtgatgaggccctgctgatcctgtatgaggaaaagttcttcttcgttctctgtgttgcagtaatcagacccagcactttgcttggggatgagaacatgggtaatggtaaattcattcctcatcagttttccacagagaattccacatgtctccactccccgggcagtgttggcactggctaactggagaaactgtgggcacagccgcccaggcaccaccacatggcgcaatccatcgattgtgggaatactttctgagttgctcagtgctccaggtttcaaggacctgtccaccacaggtggcttagctggccttacagttgtgtgacagtctgaaggctgtatggatgagactgttaaggtggggaacacatctaaggagggcttctccaagtcaggcactagcgggccacctaggccagggtctaccttcccaaactcctgtacaattttcagtcgctctttttctagctcctggttccggatcatctcctcgaaggcatggaactgttcctgttccaattgctgctgcttctgttgtgctaccctctgtttttccttttccagctcttgctggatggccatgttccgggccaattcctctgcttccttcttcttttcttcattatattctgtatattctttggtatatcgttttaacagctctgccttcagctcttctgctttgggaaatgcaatctcctttaatttctttactgtgtctttcttttcaggaatgacagcagatttgtaatctcgatgttttggtagtttctcaataaagagcgtgatatacttgttatagaggatgaaggcatgttcaatgttgccttcctcagagtaaatggatgccattcggataatctcaactccagagcggaagtaccgacggggtggaatgtcttcattcacctctaccgcactacccagctgggagagagccctcacccggtcttcgggcgggaggctcacatctccatggtcagacatcaggaccaagttctcttgggagaggttcttgtgggttaagaaaggaaccacctcccaaggccaggaagcggcgccggttaccacctggttgagcaattccaaaaaggggatgcagc

SEQ ID NO: 3932 - DNA, 505 bp, Homo sapiens
tttttattctgatgatataatttaattttcttggacagggaatggtttgtgtttgtacagcagaagctattagctaattatggacagaaagaaaggctacagatcaaaaacctctgatgttagttgttacctaagtaagtattcccaagttcataagtaaggagacaaccacactgtctgaagttcaattccctaaatttgcttatacagaaacttttgtggttactgcaagctccttctccactgtaaagtgggaatccatgtagtaagtgggccatgggctctgttcctccatcttggtgagacctgatatggttttgttgttcttggaaggtgttggactcaaacgctcatcgaaggtctgtgatggtcactgctctgtccacaacagtcacgtggctgcagctacagaacagaggtggatccttgctgtgtggatgaaatcctttctggcgacaggaagaaatctcctctagtccatggtcagttagtttaaagaatccag

SEQ ID NO: 3933 - DNA, 453 bp, Homo sapiens
tatagtttaattttcttggacagggaatggtttgtgtttgtacagcagaagctattagctaattatggacagaaagaaaggctacagatcaaaaacctctgatgttagttgttacctaagtaagtattcccaagttcataagtaaggagacaaccacactgtctgaagttaaattccctaaatttgcttatacagaaacttttgtggttactgcaagctccttctccactgtaaagtgggaatccatgtagtaagtgggccatgggctctgttcctccatcttggtgagctttttgggagtgagaaggtcactaccccatcgtccagctgctattatctaaagctaacagcacttttttcttctaggcatgcatggtggacatctgttgcctttgcctgcccagcatctacttccccttctgccaccaccattcttctttggaaatgaatgct

SEQ ID NO: 3934 - DNA, 1123 bp, Homo sapiens
caccacaggtggcttagctggccttacagttgtgtgacagtctgaaggctgtatggatgagactgttaaggtggggaacacatctaaggagggcttctccaagtcaggcactagcgggccacctaggccagggtctaccttcccaaactcctgtacaattttcagtcgctctttttctagctcctggttccggatcatctcctcgaaggcatggaactgttcctgttccaattgctgctgcttctgttgtgctaccctctgtttttccttttccagctcttgctggatggccttgttccgggccaattcctctgcttccttcttcttttcttcattatattctgtatattctttggtatatcgttttaacagctctgccttcagctcttctgctttgggaaatgcaatctcctttaatttctgctacttcagaactgttgtggtgaaatggccttatctcctattgcaggatctggtactcagatgcagagactactacttttatcttgaagtcagtctgtgctgctctgaagcttttagatgggcaacaatgaaagtgaagacccacctttactgggtctttcttttcaggaatgacagcagatttgtaatctcgatgttttggtagtttctcaataaagagcctaaggaaacagttcaaaatgattatgaagcaaatggtccaaatgtccataggacccctaaagctatgcaacccccttatcctgaagcccttatatgaaaggttccagaagtgcagcggagggagagctaatacacccagctgggccatgctcctttcccatctctatccccctaaagagccagagtcttttcctctactcccaaactaggcagcaagcaccagactcctacaatgaaaaagatggccaaaaaaattttaaaaagcctttcttgtgcccaaaaatgtacctccaaagaaagagatctttttcttgttgtgacgtgacaggttttcaaaggaaagggcttctgtcacatagcagtcttcagagaaccgtttggcaccatgggcaggaagcaagagaaaaccatgtttccttactccttctagctcttatgtaacctttaactttggcttttttcctttgggattcgtgtt

SEQ ID NO: 3935 - DNA, 432 bp, Homo sapiens
ttggcactggctaactggagaaactgtggcacagccgcccaggcaccaccacatggcgcaatccatcgattgtgggaactgtaaaggagaaaggagaatatctgcgaccactgagccctgcctcctcaagcagacctcacagccagcagccctggaggagcaacattaagccactggattcccccaacttcaggcagtgagtagggatctcattctaatggcaccaaaaaaagggctgtaaagtgtcttctccaatcttgggccacagctgtaaggagcacattacttcaagaagagaaaatagtaggctttaattattcaagttaagaaaagggcaaactactaccttaagaaaagttttcttaaaaataaccttaagaatgtaattggattgtttgtaactcaaaggataaatacttgagtggatggaaa

SEQ ID NO: 3936 - DNA, 436 bp, Homo sapiens
ccacagagaattccacatgtctccactccccgggcagtgttggcactggctaactggagaaactgtggcacagccgcccaggcaccaccacatggcgcaatccatcgattgtgggaactgtaaaggagaaaggagaatagtctgcgaccactgagccctgcctcctcaagcagacctcacagccagcagccctggaggagcaacattaagccactggattcccccaacttcaggcagatctggtactcagatgcagagactactacttttatcttgaagtcagtctgtgctgctctgaagcttttagatgggcaacaatgaaagtgaagacccacctttactgtgtctttcttttcaggaatgacagcagatttgtaatctcgatgttttggtagtttctcaataaagagcctaaggaaacagttaaaaaaaaaaa

SEQ ID NO: 3937 - DNA, 461 bp, Homo sapiens
tatagtttaattttcttggacagggaatggtttgtgtttgtacagcagaagctattagctaattatggacagaaagaaaggctacagatcaaaaacctctgatgttagttgttacctaagtaagtattcccaagttcataagtaaggagacaaccacactgtctgaagttcaattccctaaatttgcttatacagaaacttttgtggttactgcaagctccttctccactgtaaagtgggaatccatgtagtaagtgggccatgggctctgttcctccatcttggtgagctgtgttaaaacaaaacaaaaatgagttaaaagttaagcgcctcatatcttactcagccatcaataaagaatggcagctgcaccccaggcacttgccaaagatacgattctgagctcactgtcactaaatatttattaaaatggtcagtggcagaaaacaacccagagtttg

SEQ ID NO: 3938 - DNA, 557 bp, Homo sapiens
ttttttttttttttattatatttttttattttttattttttatttttttatattttatgtttttgaaactttctaatccaacagagaactcttgacattcctatcgcttcaagtcaaacacttcaaatttcttgtagacttttcttagaaaagcaactaagttgttacttggatatctttttgaacaagcatgatagataaatcatgatatggggcttaaaaggaagccctttagaataaccaacttacattataatctatgtattttacaaaggacaagtccacaagaatagagaccttttcccctgaggctttcttccctactacccccttgaaacacccagaaccatgccctctatactcactcctggaacttgggggagcaaacaatggctactgactctggcaacatcatctggtaagagcagtgagtgtgtaggtcgacactggagagaaacgcggtctgtgtggggtgagtctgaggagagaaaaagagtcagaggactcttagcgaggatatatggtaatccctccttatttgcgattccctttctgag

SEQ ID NO: 3939 - DNA, 398 bp, Homo sapiens
tttttttttttttttttattctgatgatatagtttaattttcttggacagggaatggtttgtgtttgtacagcaaaagctattagctaattatggacagaaagaaaggctacagatcaaaaacctctgatgttagttgttacctaagtaagtattcccaagttcataagtaaggagacaaccacactgtctgaagttcaattccctaaatttgcttatacagaaacttttgtggttactgcaagctccttctccactgtaaagtgggaatccatgtagtaagtgggccatgggctctgttcctccatcttggtgagcacgttttgtccaaagagctctgctagttcttgcagcaaggtttatgttgaacgggttccagtggtgaggccccctcatgga

SEQ ID NO: 3940 - DNA, 802 bp, Homo sapiens
  misc_feature (1)...(802): n = A,T,C or G
tttcttattctgatgatatagtttaattttcttggacagggaatggtttgtgtttgtacagcagaagctattagctaattatggacagaaagaaaggctacagatcaaaaacctctgatgttagttgttacctaagtaagtattcccaagttcataagtaaggagacaaccacactgtctgaagttcaattccctaaatttgcttatacagaaacttttgtggttactgcaagctccttctccactgtaaagtgggaatccatgtagtaagtgggccatgaagnntcggtttcatttattaattggatgattttggacaagtctgtgcatttattcatatcttattccatgtcaggggactcagtacaaaggtgaaaaagacaaagttgctgttctcaaggagtatactttagacacataagctagcaataaacaaacaggatgattttagctcatgacagggctacacagacagtaacagtgatgagatagagtgatggggaagaggtgcttaaaatggggttgtcaggaaaggcctctgctaaccaccagatctcatgggctcatcttgagatttaacccagcaaacctcttctgagccagttggcaccactgatctccctcccctcctttaaactgttgccttccttgatttctgtgacaagatactggtgtcactatctccttgtctcctcctacttccagctccctctttcagccttctatgcaggcacatcttcttttgaccacccattaaatttcggtgttcggccaggggaaaccttccttncgggggggttgg

SEQ ID NO: 3941 - DNA, 319 bp, Homo sapiens
  misc_feature (1)...(319): n = A,T,C or G
aaactttctaatccaacataaaactcttgacattcctatcgcttcaagtcaaacacttcaaatttcttgtagacttttcttagaaaagcaactaagttgttacttggatatctttttgaacaagcatgatagataaatcatgatatgggggcttaaaaggaagccctttaggaatancccaacttacattataatctatggtattttacaaagggncaaggcccncaagganttggggcccttttcccccctgnggggctttcttcccctacntccccccccttggaaancccccgggncccatggcccctctataatc

SEQ ID NO: 3942 - DNA, 488 bp, Homo sapiens
  misc_feature (1)...(488): n = A,T,C or G
gacagggtcttgctctgttgcccaggntagaaagcagtggtgcaatcatgcttcactacagcctcgacctcccagaactcaaagtgatggctccctgccctcagccctccctgaaatagctgggcactaacaggtgtgtgccacccaggcccagcctaatttgtaaaaattttttgtaaagatgggggtctcaccacgttgcccaggctggtctcgaactcctgagctcaagcaatccttcctgtctccgcctcccaaagtgctgggattacaccgtgcccagcctaaaaaaggtgtcttaatacacacaatacatcaaatgaaaagggaaaggctttgctagtgttcaacagggttttgactcacttgttttccctgatctcatcttaaaagttgaggtctgtcttttttttgagccatgctataagccacaatatactggtgtgaccataatacattttctggaaaaccaagcaggttagatgact

SEQ ID NO: 3943 - DNA, 482 bp, Homo sapiens
cccagaagataagtcctcaggaaagacacacaaaggcaacttgttgcagaagagaatgttaaatgttgtaccgtcctcagaaccccaataatgataattatcaaattatccaatttttgtggagatggggttttgccatgttggcccagggtggtctcgaactcctacaccaaagtcagtctcacgatgacgatagacagccagactattgataaccttcctcaggtactcgcatgggcatgtcactgactttacatgctgctgcagctccttggtgagctggctctggtcatgcgacaggaactgtggggtcaggacaatagagagcttcaccatttgcagaatgagaacagcggctcatcatgagtgccaacctataaaacatccaagtcatttaaatgtatcatcatttctgtcataattagtgggatccatttcactattattggatatacagttctgtgcctgaaacctttagtgac

SEQ ID NO: 3944 - DNA, 402 bp, Homo sapiens
  misc_feature (1)...(402): n = A,T,C or G
cttgaaggccncagggagttaancagttaatagaatgttgttgaagttggagnaggtggctgntggcccnatcctgttttttaaagtttcagctgtgaggtagggccagcagggcaatcctgaagaatgacgaatgctccgtgccgccattctgacccggttgcaaagaggctttcttgcagaaggggtgattttgcatctgtagtagtcctctgcccgccgccgcaaaccttgcgcacgttgaaacatttccctagaaaacgtatttcagatggctgtaagagtacagtctgagccggtcacggtgctgatgcctgtaatcccagcactctggnaggncgaggtggatggatcacgaggtcaggagattgagaccatcctggctaatacagtgctcgtgcc

SEQ ID NO: 3945 - DNA, 446 bp, Homo sapiens
  misc_feature (1)...(446): n = A,T,C or G
aatctggcaacattggctctgggttatgtctcctcatcagtgctggctgcagcaaatgtgatagcatgacgatgacccctggcccgtggtgggtttgccagctgttcctgcggtgacactgtataaacacgatgaccctgccttnactttagttnctggncttacatcaaataagcccacagacaaactccgtgccctgcctctgtggttatctttacaatacttgggacttgatgggtttntggagaggatcaagcatgcctgtcaactgagtcaacggttncaggaaagtttgaagaaagtgaattacatcaaaatttttngtggaagagctgcctttatgtnggcattngcgagtgacaacgtngatgctgctgaggttgtggggaccattttcggccacangcccgggaagataggggagaacttngagggtttttngaaaa

SEQ ID NO: 3946 - DNA, 561 bp, Homo sapiens
tttccatggttaaaatcggcatttattcagaaggcatgatgccaggaagaaactccccaagtgggagacaatggctggcccccctgcaagggaaacaaggcttcagcccttccctactcccagacctgccgggaaggctgggagcacagttcatggagggtctctggggtgggcctgggtgtctgacctgtccctctgcccacaggtgaatgtgacctgcgtcctgaggatcccgagtatcacagcagacccttgaacactgtccacctttcccgaagggagaggctggagctggagccaacaatttgatgacgagtgtggggaggatgtccgccaggagcacagcagccgtagagacagagttgcagtcaaatcgtgatgagctgttgtgggggatcggcgttgggcctgggtccacatggctctggtttcccgatgtcctcttgtggctaaggatgtcgtgggcggcactcagcatcaccacataagagaagttgttgcaaaggcccagcagccctcggaatccgaaaagcgcccgcgcgagcctgcacagcctcccat

SEQ ID NO: 3947 - DNA, 217 bp, Homo sapiens
ctcacctggggcagcgtaggtgtgcatgacattgtgctccaccagcacctgggccaccgaggggtctggaaccgggaaggactcgttgtacggaggctggaactggtggagggcctgctccccatccccaaaggtccacctgccggggcggtgggacgcaccatggcagcgtcctcgggcagcatgaagcagacagaaggcagaggtgaaggtggag

SEQ ID NO: 3948 - DNA, 467 bp, Homo sapiens
tcccaatgggtctctggtcacgaggaaaataaaaaaggtgtagggccggtggtcggcaccctgaagggactctggtcggatcctcctgctagccgagcagttgtgctcattgggccggggctccgagtgcaggtagactgccaggtagggctcgggttcctcagacaggtagcggccgtccagcagcgtatagttgagctgcagatgcagcacggccgcagggttgctgctgtccagggtgaccacagcaccgacggaggcctggggctggaccacaacggagttggcagagctgcggtggagacggtgtagttgctgatatagccaaagggaaagggattggagtccaccagaaagatgagctgcaccacgtcactgaggttagccggggccctgctgaaagcctaggggatggagaagtggcagccaggccctggggcgccgccatagcacagcaggctccctcg

SEQ ID NO: 3949 - DNA, 14136 bp, Homo sapiens
gcagtcagacagctcttttattgactttgtctgcttggtgcgggggttgggggggtgtcgaggctctagaagcggccatgcccacagaagtggtacacagaagcaggcacagccagctccgagggccttgaggctgcctgggccatacagcacactcgcgcgtcgcgcgcgcacacacacacacacacagtcaccttcctccaccctgggagccagcccccaggaggagtcttttcctctaaccaccctggggtcctctgacatgcctagtcctgctacttgcccagacctgatgccagcaggcctgggcgctgctctcttgctacctggcctggggcaagggaggatgacaaggcctctggggtgatgagagtgcctggcagacagctgtgcccccagcaccggcccaaggccaagctcgcatccaagcagcagccgggctgccataacgccaccacacctaccaagcgcagcaggtgttgggggaggccagctctgggcgcaggcccctcagccctagtgaaaatagtgacatacaaaaatatacacattttaacaccatataaattactgacacgagacacacagtgagacggtgcagggagtacggtaggaactggagaggtaataacttaggggcagggtggcggcggtgcaggctaaccctccctgaagccagcagccttagcagtgggggacatctgcccagggggtggggccgggcacagcccgctgtacctgaggactcggggaaataaattagcatctcagaggctagaaaccgtccaatactgctgtgtccttcccaagggagctggggaggggaccctgggtcctggttggccacacagcctctttaaagtgctgaagcccacagacagacagatgcccctgcctgctctctggggaacctacgtgcagccattctgcctggccctcggccttgacagcggcagaaagtaatactgagcggtgtccactccgactccacggcccacccccgccaggaaggaggactaagtgctgctggggtggaccttgttcttggcccgaaggggtgtcctgctggggccagtggccaggtccacaccccgactggcccgggcaaggcggctgggcagtgctggccgcaggcccggggatgggccacgggaagatccggcgggcgcccggctgctcctgcggccttgcaggctgtgcagctgctgctccagctggtagacgtcctctgtggcctggttgagtcggtcaaactgggtgagcagggcctcgaacacggcttggaggcgggagggctcaggctcacaccttgtccccagccggcccaggctcacgctcagcccatccagctggctggaggaggtggaggggtgcgaggcatcggagccagcgctgggtgggggcacatccggggataccttggagcccctggaggagcgagagggcagcggctccatcccttcaaagcggactttgtggcggaactccttgaccttgctgaggcccatccagaggcgcagcctgcgcaggaacaactccaccatctcgtagtcctggggctcccaggccggccggtacagctctccacgcaaggcgtggtagcgccagcggagaataacagcccccagccgtagggcgccccacagccgcagtgcccagagccccacacacagcaggggtgacaggtgccaggactcggcaggacacagggtagagagcccagtcccagggcacagcaccaacagggcctgggccacgctccagagggagtccacacaggaagacacgagcaggatggccagctgggcgtaggctaccccgagcaccaccaggcccaaggtgacccccaggagctctggcagagctcggcataatgtcttgccaaagacggaccactggcgcacgaagcgtagctgctgggcagccttgaccaaaagcaggaagagcagcgaggccgccaggccacgggctgcggagctcagctgcgccacctggtcgaagctagtgaagcggcgcgggcggccgcgcacgaaacgggtccactggcggtcagcggcacccagctgggcgaggcgtaccagtgccgtggccgccgtcagcgccaccagcagccaccgcgcccaggctccgagccgcagcacgcgccagcgcccttccctgtgccaagtacgggcctcggccacggcgaagtgcacggcgaacagcagcaggcacaccgaggtgagcagaggcagcgagaggcccgcgctgaggcggcgcagcgcaaaggggcggacgctgagggcggccagggcgcggccggccgccgggaactcgaggcgcagcgtgacggcggcgtgcagccccacggccgggctgtagcgcgtgagctccaggaacacagcgcggctcctgttgtccagccagttgtgcagctgcaggaagcgcagccggtcgcggctctcctccaggctcaggcccagctcctgcacgtagcccccgctgtcatacacggcacaggagccccaggaccatgcccccagcagatccggcgctgaataggcccacgtccccgagccattgtgaggactctcccagccaacgtcgtaatcgctggtgctgaagcctcctgcggccgagcacgtgtggaccctggggccgggagggtctgggtagagtgcttcctgcagccgcacctgccgcagccgtgggggccccagctctgggctggactggttcccgtggacgtagggcagcagcacgtgggccatccatggccagagctcctcagaccgcgtgatggccaggaaggcccggctgtgcagctcctgcttgatggcgctttgcagacggtaggcgtgcccatggcatgaggcatccccatagctggccagcagggtcaccagcagaaaaagcatgtacaccaggaggctccgcagcatgccatgtagcctcttgaccttgcgggcttcttccttggccaggaagagtgcaaagccgtggggtggccgtacgcggggcacacgtgcgctcacaggcgtcacagccgggctctctaccagggtgtcatcttcatccgggtgcagccgcttggccaccagtgagaagtacagggcttccagcaagaccttcagtggctcccagccgaggaatgaggccaggaagctggcgctgctggacaggagccacgcaacactcacgcccggggggaagctcgcacccacccaccctgagacagccacagccacagccaccaggagcaggctgagcccgtgggccagggaggcacaccaggccggcagcaggcgcttccgcagaccctccaccagtcctgtcctggacagcctcgctgcctggggctgttcccagttcaggcctgggctgggtggccccagctcccccagcctctgcagcgccagcgtctctgtcttctccccaggagtgctggacaggctgctgagcaggtccgtttccatgtgggtgtcttgggtaggggctgggctgctgaccccctcggcaaggacctgctggatcaggtcttcatctgatgctgagaaggatttggcaggcgagtaggggctggccagggagaagccgtcctcctctgggcccagcccatggcccgcctggccccgtgccagctgccgcagattgctacccacaatggacgggtcactgagcaggtccggccaactgagcgttccctcgccggagggccagcacaccagactcttagaatcatccagaaacaagtcactcttcatctgtccaacaaaggcctcagcgtggaggcctgagaacgtgaggaaggagctgtccagcacggacgagtccaggcagctgtcgatgtccagcacctgctgcccggcaggtgtggggctcgggctcccagccaccttgctccgggacatccggaagagaaaaaggatggccaggtagacgggatagacaaccacgctggacaccaggccaacagcgactgtgtcgacgctcagcgggctcagcctggacacatgccccgtgctgtaggcagagtcgccaacagccccgtaccacacggcgttggcgcccaggaagaggcagatgaggagaacgcagcaggtggccctctggatgcgagtgaaacggctacgaggcggccggtcccatatggagagccagatgtgcttgtcaaagaagccacgctgcagctcagccaccagcaggcgccggaagcgcaaaagggctgcgtcgctcgcggccagcacctccttctccaccaggcccccgttggcctccgtctccaccgaaagccagtcattgaccaggaagaaggcgctgcgtgccgtctgcaggtccctgacgatgacgtgctgcaggaaccaggcagggctgagccctttgttgtcgtgccacactcggatcttccacacgctacccaggctgtgcggggtggcgatccggaagatgtccaggctgttgcggtggaaggctctgtcgccgtccaggtgccggtggccgctccggctgtccaccccatacagcatgatgcccacgtgggccgtggtacctgagccccggccccagcctgtcttgacgaggatctcgtacttgaagcggccccgctgcccacagaaagggatggcgcggccccggctggcatccaactggtccagcttgtgcaggatggcggccatgaccatgtaggtcaccaggcacacagcacatgtcagcatgacgatgtagtttacatccgctgtcggctcaggaaacacaaagcggacatggcttgggggcacgaagaggctggcgccgaaggcggtgaggtggcgggtgaggcagacggcctggcggggcgaggtctcctccaggggcagcagcccctctgtccgccacaccatgtcctcctcgctgaagtactggcacagggacgtgtacaggcccacggacacctgcagcgccgaccagcggaagtggctggagaggttcagatggtaactccccgctgggtctctgctccccggggaaatgaagaaggtgtagggccggtggtcagcaccctggagtgactctgggcggatcctcctgctagccgagcagttgtgctcattgggccggggctccgagtgtaggtagactgccaggtagggctcaggttcctcagacaggtagtggccgtccagcagcgtatagttgagctgcagatgcagcccggccgcagggttgctgctgtccagggtgaccacagcaccgacggaggcctggggctggaccacaacggagttggcggagttggcggagctgcggtggccccgggcagcccagtccgagttgttgggcaccttcacggtgatggcgcgctctgaggccagccgctcgatggggatctgggcgccggcctgtgtctggaatgccatcgaggccaccttggtggagacggtgtagttgctgatatagccaaagggaaagggattggagtccaccagaaagatgagctgcaccacgtcactgaggttggccagggccccgctgaaagcctcggggatggagaagtggcagccaggccctggggcgccgccatagcacagcaggctccgcgggtccgagcgcttgccctgggccacgatctcctcgcccgccagcgtcaggggctcctcgttgagcacgcgggagcgcatgaggatgcgcatgagggcagaggtcaggttgtaggcctgggacgccaccatccgagatggtgactcggctcccagctctgagggctgtggtgcccgcacgtccgagctggccaggtggatgaggtctcctgtgatgttgaggatgctgtctccgatggcggtgggcgtcacggtgcccgcggtggtctctgcctgcaggatgagcatcatggcctccagcttgtgcagcgtctgcttcaggcacgagcggcatacgagctccctgctgggccccatgcactgggccagcgcagcagcgatctgctggatgtcatccacagtgtggaccctcagggacaccagagtctccgtgatgttcttgcgtatctgggctcggtgctgccgctcgtgcttgggctctgccgccacgtccagggcccgctcgtactcgttcagcacggtgaccagggccaacgagtactcgatgacgtgctggggatcggcctgccgcagcagccctgggagcacactagcggtgagcccgtgcagccagactgtgagccccgttgcgctgccgttgggctctgggagggtgatggccaaagacctgttgagggcgaccacagcggctcccagctggtcctgcaccaccacggccaggcccacctcgaagtgtggcctgaaacccgggggcagcacggctccgtagctggagaggctgcccttgtagacacagaactcctcgcagtggccctggcgacagcgccgcagcagcagggcgtacaccagcggggcgccagcatcctccgcgtcatgccagcccgtgcattcgaagtgcaccttggtggtgagggcgtgcacagcgcccagtgggaagaggcggcaagagccccccagcggcgggcggttgggggacaggcggatggaggcgcagccctcctcctcgccagagcggcccagcaccgtgagcgtgaaggtgtatccctcgccgtcccgcagcacgccccgccgcagcaccagtcgcatgcctgcactgcccgtggatgtggtggtctcatccagcaccagcgtcttgttgctgaacgtacgtgcagcccaccgccctcgcttggagccgctgctgcaattgaggcagcggccctccaagtacacgtaggagctgcggctcacttcgtacacggcctgtgccttgcaggacacacactccaaggacacaatgggcacccggccactccggatcagcaccgtctggttggtggcctcctccttgcggccggccttccacacggtcaggctgaaggtgtactccacgccagccgccagccgctcccgtggaatggtgaccgtgctgctcccgcggggcccaaagttcagcgcacacccgccagcctccctctgtgtcgaagccacacaggcccagtggaaactgagcggcgtctggtcgccgtcctccaggttggggtcgtaggactcgctcccatccagcaccaggtcccgtgtgtctgaccacacgcggtatgagccaccctcaatgatgggcaccaggcgctcgggggccaccgtcacattggcctggatgctctgtgtcagtggcgtgtccccaaatgacacgacaaacacaaagcagtagtgccccacaggcagcgccagccgcggcagcaccagccgaggccggctcacgtccacgccgggcagggccacacgcgctgggcgccccggccgctggcagctggcggtgcgatacacctcccagcggtactcagtctggtaggtgacgcagtcgcgcaggtcaacgtgggcctccaagtagttgcgctgtgatcgccgcatcagcacctgcaggggcaggaccacgtccacctccggctcccggcaggccagcacctggacggtcaccgtggcctgcgccacgaagaagctcaccaggttggaggcgttcacctgcacgcggtagtccccaggcctcaggtaggagtgctcggccctgggctcatctgtgtcctgccctggcgacccatccccaaagtcccagtggtaggccacacgccgggggctggggctggtggcggcctcaaactgcgccgagcggttggtgaagcaggggccgctctgcagggccacatactggacggcgtcctgaacctccagcaccagcgtgcggttctcactgcccagggcgttgaaggcgcgcacctggatctccaacagccccgcggccacgggcgtgtaggtgacgtcgcggcccgacaggatgaccagcgagtcgccctggaccttctgcagcgagaagtaccaggcgtaggcgacccgagagccgcgctgcacgcgggctgtgaagttcctctcagtgcccgtggcgatgccaggctcgcagcagttgggcatctgcagcccactcacggcctccagcaccacgatgcgcacctgcgcctgggcccagctcacgtggtttttgccccgcacgctcaccacgtggtctccgacgcgggggaagctgtgggagaaacggggcccggggagcacctcggggttggccccgccgacctgcaggcggaaggtgacagctgagccggcagccagcaggatctgaaaatggaccagctgcccgggcgccaccaccttgctgctggcccacagcaccaggcccacgatgggctcctccgccgtgaggttgtacgtggctgagacccagctgactgcgttggaggcattgagccggatggagaaggtgccagcatccgggaagaccatggtgacatgagggccacgcttgctgctgccgccgggcacagcccagcaccagctcacattggtgcccgtggccagctgcccccaaaagggcacagaggacccggccgccacgaagctgcctccgggctcgctggccctgatgctgaggccactcacaggcacctgcacatccacttccacggtggcgttggctgagcccagcgggttccctgccgtcatggtgaccaagtgcaggccgggtgtggggaagctatgggtggtaaatggctcggaggtctcccagctcagcccctcctccaaggaccaagtgtatacgacaccactgccaccagccagctcggcactgagggtgacgcttgtgttgacggcagctgggttcggggaggcggtcaccatcagccaccccacaggctccacgaagtccatggtgcagtcggcccaggcgctgcccagcatgttggtggcccgcagctgcacatggtaggtgccggcctcgagcacggtgagcgagaagcctttgccgctgccggccagggccgggcccctgtccctccaggcagtccagctgtaggagacgttggtgccatccctaaccacggcctgcagctgtaccgtgtggttggtggggaagtagcggccaccgcccaccacctgcagcccctctatgagctgcaggacatagacgaagatgctgtcctgggcggagcccacctcgttctcagccgtgacgatgatattgaaggtgcccacggagcggaaggtgtaagagatggtaggacccccagggatgggcgtgcagcggtcacagagcacccaggaatagcgcacatcactgccggcctccagcgacgtgctgaagctcacgctcccattcaggggcaccaccgtgcggcttgcattgacgacgagcccccgcacgcgccgcttcaccgtcacattgagccaggcctcgctgcggctcacctcattccagccggccaccctaacggtgaagtcacctgtgctgttgtaagcgtgggtgacctccggaccctcgagccacccaccgtcccccagatcccacaggtagctggcggggcgcccacggcccacagcagagaacaggtacggctgctgcagctccagcccaagggagccattgaccttgatgctggtgaccagcacgggctcctgcacctccaccagggctgagtcattggcagcagagatgttgttggacgcggtgactgtcacaagataggagcctgggtctcggtagatgaacgtcacctcagggcccctggcacgggtgggggcggcttcctcggtgccaaagtcccaggtgtagcggtaggggaacgggggccaggcacatgccaccagccaggcctcgtccccgagctgcacaaactgcctctctggctgcagggtgacgttgcccacctctggctccacgcagatgctggtgaagtaatgcgccctgttcacgcggctggacagcaccagcgccagggggaacgtgccgctccgcgtgaagttgtgtgtcaccgtcgggcacccccgcacggtcgtgttggaggagccatccccgaaggtccagtcgaagaggtagtgggccgggttcccggtgacgtaggccgtgagccgcgcgtcaggctgcgtggggatgcaggcggcgggttcaacgcgcagcacctccaggacgaagaccagcacgtgcaggctccgggccaggtggccggcggggctggccgcacccacggtcactgtgcagttctgtgcccgcaggtacacatgctccactgttgcctccgggcccgacagcacggtgccgtcccccatgtcgaaggtccacgtgatgttgtcgcccgtctgcaccgcggcgctgaccaccacgggggcgccctgctccacggccaggctcatgtccacgctgagtccgcggagctcctcaaagacgcgcacatccgcctgggccgccgcaccgctcaccgtgttgttgacctccaggcgcacgtggtaggtgcccctcgaggcataggtgtggttggcagccggctggctctgggtcaggacaggggagccgtccccgaagtcccacgtgtaaagaacacccccaggcgagggcagcgggtgcgggtagaaggtgacgggccggccggccaccaggacgccgtcactcacacccacagccacggagggcagggaggcgcgcacgctcacaggcacctgctgcgtcaggttctcgaaggcattagatgccagcacggtcaggaggtactcacctggggcagcgtaggtgtgcatgacattgtgctccaccagcacctgggccaccgaggggtctggaaccgggaaggactcgttgtacggaggctggaactggtggagggcctgctccccatccccaaagttccacaggaaggccacctccacggccgagtccaccagcacgcccgccgtcagtgctagcgtggcattgggggacagcacggccggcactgtggagacctgcagaccctgcatcctgttcatccgctccacggttacgttgtagttcacggtgacgttgctcacgtggttggaggccgtcagtgagagcttgaagaccgccgcgctctgataaatgacattgaagaccacgttctggaaggtcagggactgcttgtcgttgatggtccaccggaagaccatgtccgagccggcctccaccacggggctgtacctcactaggactccctgcagtacacgggcctcggggctgggcgtggcgcggaggccacagatgggctcctccgccgtcacccgcaggctgaggttggcccggctggcgctgttttccaccaccacgtccaccacgtgctccccctcactgagccacggcagtgctaccactgagaacagggtatcgttggtctcccaggggcagccgggcacgaaggtggccaccagggcagggcagacattctcaaagcgggcgctgacactgcccccaggccagcgagccgtggccgtggcgttggcaccagagtccacctggagcaccaaggctgagccgttggtgggcacgtagaggcggccgtcgcggggggcagggtagatgacccgcagcccagccactggggagaccacgtcaaagctgcaggagaggttgtgcctggacacgccattgcccacctctgcccggacctcatagcgcccaggcatccgcagtccagggttgggcctcaagcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcaggagggcgccagggccagcgtcgtgctgcaagccaacgaggtcaccagggagcatgaggacatcctggccgtggagggtgaccgagtactgcgcggggggccccgcggcaacggagaagaggaactctctccatagcgcatagggggccccgggtagccctggccctgacgtgcagccattggcgcaggcctgggggtggcaagaggcgtccagcggcaagcagatgttggctccagggcaccagcgtccccctggcatgcacgcgggggccagctgggtcctgttgtccggggacctgctctcaggctcgctgccgttctccggggtccctgctgtgctgaggagccggtacacctgcagccgcagctgggcgggccgccggagctcctgggtcccaaattcggccgtggtgaggaaggcttcacggctcagacgcaggcccgggaataccatgacctccacgggctcgtgcggggctgagaggccgtcctgctgtgccagaggcgtcaggggtccctgcaggtccccactgggcgctcccacgaggaggttctcggcatcctgcactgggcctccgggctgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggcgctgggcccacctccaccccctgcacagtcgagaagccgatccacacgtctaggctcctggtgacccgggagaccaggaagcgctgcacggcgggactgtccaccattgccagggcggccccggcccaggcctgacactgctcctgcgcctgcagccaggccgccttctccaccaccaggcggtagcagtgcccgttgccagggaagatctccgtgtccgaggggcagagcgggtgcaccgctcgggccggctcctcgcccagggccacgatgctgtaggcggcctccaggcctgaaccaccgcggttctggatgctgaggtcaaggctctcgtcactctgcaccgaggacgggcacacgagctccagggcggcaggtgccgcttccacctgcacgtctgtccccagcagggctgagccggcccccagggccagcacggccgtcacgtgatagcgcccaggcagcacatagcgatgcgaggcagccggcccagcggcatccacctcggcggagccgtctccgaagtcccagcgtgtggcagtgacagggagcggggcagcgatgtggaaggctgctagctggccagaggccagaggtccgtggggccccaccagggtggcccctggggaggcagggaagacgtgctggaggagggtggggcccctacaggtgggggcaggaggtggcggggggccggagcagagggacaggcaggcaaaggaggcactggagggctgggccgccccacacaggcaccagccctgctccgagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttatttcacttaaattaaataaattagcaaatattccttcttctaacgtagaaatcttgttgttgcttatatccagctctgccagcgccgagaggttcgccaggagcccaacgtccagcgcccggagcaggttgtgggagacgtctagcgctgtggcgtccgcggggatgcgcagcgcgggaccgagcgtccgcagcccgcggcccgagcagttgacgcggcaggcggcgccgggcgctgggccgcagaggcaggggggctcgcagggcccgcagccgcgcccggggccccccgccagcgccccgagccacaggcccaggcccagggccagcgccaggcgggcgggcgcggcgggcggcatcgttagggcagcgcgcgcatggccccgccgtccccaggcccgcccgcgcgcggagaccgcagctcaggcggggcccgcggacggcatggcgggcgcggggctggatggggctgcgcggccgcgacctgctgctgagcgacgcccgctcggggctcggggccaggccgctccgggagctcggccgcccgctcggacgctggcgctgcagtgc

SEQ ID NO: 3950 - DNA, 364 bp, Homo sapiens
cttccaccaaagtcaagtcccacgatgacgatggtcagccagagtattgataacctcttagaatcatccagaaacaagtcactcttcatctgtccagcaaaggcctgctcagcgtggaggcctcagaacgtgaggaaggagctgtccagcacggatgagtccaggcagctgtcgacgtccagcacctgctgcccggcaggtgtggggctcgggctcccagccaccttgctccgggacatccggaagagaaagaggatggccaggtagacgggatagacaaccacgctggacatccagagggccacctgctgcgttctcctcatctgtctcttcctgggcgccaacgccgtgtggtacggggctg

SEQ ID NO: 3951 - DNA, 416 bp, Homo sapiens
gtgcctttgtcccagcccaagatagttaagtgggatcgagacatgtaagcagcatcatggaggtttgaagatgccgcctttggattggatgaattcccaattctgcttgcctgctttttaatattgatatgcttatttttccatctcttgccctcaaagcttgttaagatagttaagcgggcataagttaacttcccatttacatactctgcttagaatttgggggaaaatttagaaatataattgacaggattattggaaatttgttataatgaatgaaaccttttgtcatataagattcatattttctttttatacctttgataaagtaaggcatggttgtggttaatttggtttatttttgttcccccagttaaattaatcattaaacttggaaaaaaaaaaaaaaaaaaaaa

SEQ ID NO: 3952 - DNA, 325 bp, Homo sapiens
tttttttttttttttttttagctgagcatcatttaaggccttcatttggaattgtccctgtgggtaataagttacattcactcttcactaatttacagtcagggcccatttgctattacaaatatggaacctctgacactttgaatattagatcaggggccccactgggtggggatgaaggtgtttttgcacaacacggttaccaacagggatgggactgtgatgcttgtaggcagccttcctctctgccatctccctctgcagggcttgagcacagagccagttgcaaagaggctttcttgcaaagggggtgattttgcatttg

SEQ ID NO: 3953 - DNA, 1109 bp, Homo sapiens
tcaggagagctggcagaggaagtcatgcagaggcaaagccaggagccccgacagggagatccccagtgtgtcagagatgcaggtggccgccattgcaaactcccggtgctcatcactggtctccagggcgatgttgtggaaggtgttcacgtaggctgcgcctcccaggagcccctcatacagaatgatcaggaagacgaggtagatgcttggcagaaagccgaaccacacgtctgccagcaggaacaccaggttgaggcactgtaatcccagctactcggaaggctgaggcttgagaatcgcttgaatctgggaggcaggggttgcagtgagccaagattgcaccgctacattccagcctgggcaacagagcgagactccatctgcagcagggccagggcccaggtgaaacggatgcgacagcagcggagagaagagcgggaggcaaagacgccagcctggtacagcatctggtaccagcggtattgctgagcgtgactcagggaagtgttccagaaaaagaggagttcaaaaagtccctggttaatgaaatactcggcaaagtaaactacgaccaagggaacaatgtaccacagcagacccttgaacactgtccacctttcccgaagggagaggctggagctggagccacacaggctggtccccacagaatgagaaaaggcaaccaggacgaagcttccagcagcacaaatcccactgacgagaacccgggggctgtagggcagcaggtgaaggccaagaggagccaacaatttgatgacgagtgtggggaggatgtccgccaggagcacagcagccgtagagacagagttgcagtcaaatcgtgatgagctgttgtgggggatcggcgttgggcctgggtccacatggctctggtttcccgatgtcctcttgtggctaaggatgtcgtgggcggcactcagcatcaccacataagagaagttgttgcaaaggcccagcagccagaagcccaccgcgttcttccaatgcgcgccctgatggtccaacagagggagccggggctccgggacggtctcctccccctcggaatccgaaaagcgccgccgcgagcctgcacagcctcccat

SEQ ID NO: 3954 - DNA, 1266 bp, Homo sapiens
tcaggagagctggcagaggaagtcatgcagaggcaaagccaggagccccgacagggagatccccagtgtgtcagagatgcaggtggccgccattgcaaactcccggtgctcatcactggtctccagggcgatgttgtggaaggtgttcacgtaggctgcgcctcccaggagcccctcatacagaatgatcaggaagacgaggtagatgcttggcagaaagccgaaccacacgtctgccagcaggaacaccaggttgaggcactgcagcagggccagggcccaggtgaaacggatgcgacagcagcggagagaagagcgggaggcaaagacgccagcctggtacagcatctggtaccagcggtattgctgagcgtgactcagggaagtgttccagaaaaagaggagttcaaacccagccatcatccgaaccttgaatactgtccacctttcccgaagggagaggctggagctggagcctggcttcgactccggggcctcggttcttatgaggggctgccgggctgcgctctctgcttcttcttcccctccagggtcctgggcctcaggagatgtgagcaacaagaaatagctggccagcagcagggcagggatacccagcatggacagcagggtctgctgaggggagaggccggcctgggtgaggcccaggtaggacagggcccccagcagcccagctcccccagtccctgaggaccaccaggagatcacggccctggggtagaaggcagtgagggagaggaaggtgacctccccaaggcctgatgagatgctagcgaagaccacaccacacaggctggtccccacagaatgagaaaaggcaaccaggacgaagcttccagcagcacaaatcccactgacgagaacccgggggctgtagggcagcaggtgaaggccaagaggagccaacaatttgatgacgagtgtggggaggatgtccgccaggagcacagcagccgtagagacagagttgcagtcaaatcgtgatgagctgttgtgggggatcggcgttgggcctgggtccacatggctctggtttcccgatgtcctcttgtggctaaggatgtcgtgggcggcactcagcatcaccacataagagaagttgttgcaaaggcccagcagccagaagcccaccgcgttcttccaatgcgcgccctgatggtccaacagagggagccggggctccgggacggtctcctccccctcggaatccgaaaagcgccgccgcgagcctgcacagcctcccat

SEQ ID NO: 3955 - DNA, 302 bp, Homo sapiens
ttttttttgggcatggctgtaatattgcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtcccaacagggatgggactgtgaggcttgtaggcagcccttc

SEQ ID NO: 3956 - DNA, 442 bp, Homo sapiens
  misc_feature (1)...(442): n = A,T,C or G
catcaaggtaggatctaatatgttcaacaaagtggggtggctcagccagaggcgaagtggaaagattctcnagtatttgcttgtcatcttggtgcaacccagaaatccacatgtggaaatggtgtccaggagtacggtcnctatacgaagttgttctgtctctgcatcataaatgctaatcattggtcctcctgctaaagttcgcgcagcacgaagctgctcctccggaccccgatcttgaaaggaggctctgtaaatctctgcagtcttaatgttgacagcaatgccatatattactggaaagtggttttcgttttcttcccggtcatttaattctgtcacacataatgtcactaagtgaatgtcatcttcttgcctgtcaaattcaccttccacattgagcgtggtcagaaaaggattttatggagttcatgatcaaggg

SEQ ID NO: 3957 - DNA, 429 bp, Homo sapiens
gtgttcaaggccaaaaaccgggagactcatgagatcgtggctctgaaacgggtgaggctggatgacgatgatgagggtgtgccgagttccgccctccgggagatctgcctactcaaggagctgaagcacaagaacatcgtcaggcttcatgacgtcctgcacagcgacaagaagctgactttggtttttgaattctgtgaccaggacctgaagaagtattttgacagttgcaatggtgacctcgatcctgttcttccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgta

SEQ ID NO: 3958 - DNA, 509 bp, Homo sapiens
tttttttttgttttatataatttattcttatttgtgattacaagtatacctctacagaaagttagtatactcacacaaaggcaacttgtgcagaagagaatgttaaatgtgtaacgtctcagaaacccaataatgataattatcaaattatccaatttttgtggagatggggttttgccatgttggccagggtggtctcgaactcctacaccaaagtcagtctcacgatgacgatagacagccagactattgataaccttcctcaggtactcgcatgggcatgtcactgactttacatgctgctgcagctccttggtgaactggctctggtcatgcgacaggaactgtggggtcaggacaatagagagcttcaccatttgcagaatgagaacaggggctcatcatgagtgccaacctcagttttcttctgtgtgaaacaggaacaatagtttcattcgtcattcagtttctctcaaggtttcacgagatcatacgttacagtcaggggg

SEQ ID NO: 3959 - DNA, 450 bp, Homo sapiens
  misc_feature (1)...(450): n = A,T,C or G
cttttgatcctccagcaagtagattgatattttctcctggtaacaattctaattgctcagtacattcaacaaattttccagactcgaagctgcttaatgatctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctggggaagtgggaggttgtagccgagatcacgccacttgcantccagcctgggcaccatttnagcactgngttaacaagattccgtctncaa

SEQ ID NO: 3960 - DNA, 578 bp, Homo sapiens
ggggcccgggccatggatgtgcgccgtctgaaggtgaacgaacttcgcgaggagctgcagcgccgcggcctggacactcgaggcctcaaggccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcagtggtctcccaggtgccagacccaaaagcttttcctacagtgatgccggttattttcacttccccatgactaaaatgcccataacatgattttaacaaactgcacttattaagaaatgtgtttgccctgttttgtttggtttcgttttgttttctttgaataaatgacatggcacctcctagcaggaaggaagcagggtt

SEQ ID NO: 3961 - DNA, 809 bp, Homo sapiens
ctaaagcccagaagacagaccagtgcaccggatgcccgtaccgcgtgatggccaggaaggcccggctgtgcagctcctgcttgatggcgctttgcagacggagccagtgaccaccgaggctgtgccactgcatcgggccaccatgctgatatgcccggtcccagagctgctagagaagaggtacagaggcagcgaagacacgttgagggggaggacgagaccaactgcgagacgccgagtcccgggctctcaggacgctctcccgtaccctgcgcccttcgtcagcccatcaccgaaaagaacggcctgaccccagggtcacactgcactgaatgcttcctgttttgctgtctctcggaggataaaagacactcttggctgggcgcagtgtctcaagcctgtaatcccagcacttcaggaggctgaggcaggaggatcacttgagctcaggagttggagacagtgagaccctgtctttacaaaaaattaaaaaatgacctagcctcaacttggtcaggcggtgcgtgtcacgccttgcaatctcagcaccttgggaggccgagatgggtggatcacgaggtcaggagttcaagaccagccaaaaatggggtatttaaaaacccgcccataatttctcactgctctgagaccaagataaaaacgtgccccggccagcctcacacaggagcctttctgctcctacaaagccccatgagcctgctccctccctagagggaaggttctggggccctggggatcccatgaggctctttccacagacaacagaggttcagagaagtgaagtggtg

SEQ ID NO: 3962 - DNA, 558 bp, Homo sapiens
ttttttttgcctttgccagaataaggttttattttgaaagtcatttgaaaaacactgaggaaggaaggagaagacctaagacccaatggatgtaggttccaaatttggattcttgctggccccaccaatggtctctgtcaggccaagaaggttctgctttctttggtaattcctatttttttagcttcctggagaagagatcttttcccacaagccatcttcattttttttgtagagtagggctttatttccaggaaacagtgtgttagttggagcagtatttttttttaaaaacatcaaggtagatctaatatgttcaacaaagtggggtggcttggccagacacgaagtggaaagattctctagtatttgcttgtcatcttgctgcaagcagaaatccacatgtggaaatggtgtccaggagtacagtcctatacgaagttgttctgtctttgcatcgtaaatgctaatcactggtcctcctgctaaagctcacgcggcacgcagctgctcctctggacctcgatcttgaaaggaggctctgtaggccaggcacgg

SEQ ID NO: 3963 - DNA, 827 bp, Homo sapiens
cactttataaacaatccactttatttagcacaggccttcaagaaaacaccagacactgacatgatgaattgctctcttgggagcacgggtgggtgagactggggaggaggatgggaagtgagaacttggtccgtttaccggaagacagcagcacacagatctgcttgcaccctgtacctcattgtctaggataacaggattccacagccttgccctgatagaagcaactcggcaattaatgggttgatggcccacagtccttccaaggaaaacccatgtttgcttgctgcagccacgtggacaacaggcaggctcaccacagtgcctgcaggcccttcctggtctctcaatttcactccttcaaccaagcgtttagcagatgcctccttccttattaccttctggtattaggtgctggggatacactggggagaaggttcttgttcttaaggaacttctgatcctacagcaagccagtgatgaggggagaagtggtagaatgggggggattcacctcatcgcccctttctaagcatcagcccaattcttgcacatccatcaaatccttgtccagacacctcctggaactcttccctgcagccccctacaaccatccccacctcttccgggtaccccgcaggagctggagaaggatgaggtcggggcgaggagttcgcggaagcattggcaggcctggactctcctttgcgctgtttcgtggtttatttcccagctctaaacaaggacgtcctgcaaacttctgatgggtttggttttgtggtaacttcttagagagctcagagcatcaaggaagaacatttcctcag

SEQ ID NO: 3964 - DNA, 695 bp, Homo sapiens
tttttttttgttttatataatttattcttatttgtgattacaagtatacctctacagaaagttagtatactcacacaaaggcaacttgtgcagaagagaatgttaaatgtgtaacgtctcagaaacccaataatgataattatcaaattatccaatttttgtggagatggggttttgccatgttggttgtaaaaggagagaccaagtaagtgggggttgaagtcagattagaccaaaagtgaatggcagagagtattataatgtccatgaagggttgctagagtcaccgtgatcatagcccaagcagagacagggaaaggaagatgtgagcagagtttggggtctcgaacaatggaggttattcgtgcagcccaggaaaggctccccaaagccaggatcaacctcccttgcaggcggtccctcatggaggcatggccaggcaccttagatttgagaccagctattgttgctgctgaccagctgtgtgaccctgggctggtttccttccacacaatgggagtgccaatggctgcatgcatgcaaagaccgtctgaggataggaggaagcaatctgttgagcacccgtgtacctgagtgtcatcacctcccaagggcatccttcgttccagagctggcaccttggaaggcccttggtcactgaaggcagtgatgatggtaacagcagtaaatcatca

SEQ ID NO: 3965 - DNA, 585 bp, Homo sapiens
tttttttttttttggtgggagatttgaatatatttctcatgagtcagcagatcaagtagatagaaaataagtatataaaagaattcaatgacacaattagatacatgtaatagagattacatactcttcaaagcttgtaataagtcaactcacaaacactgattttaagtccttccacaaagaaaatctcaataaaatagggatataataagtcacttccctcctagggcgataatgtgtataaaagtcgtttaaggtataaagccttagaaaacatttgttccttttaatgccctgatgtgttttatcctaggaacggcagcagtaggacacacagacaaagattgggagattgaaagaactctgtgagcagtatggcatatggcttcatgtgggaggggtaagctggccggtgaggctgggtggctccattcgggcctgcacagagtccttatgaggactggacatccaggctctcactttggtgacatttatcacgaagggctctttgggtcacagatcacaaaataacccaaattggcttaagccaaagagatcttactggctcacataactacaaagagc

SEQ ID NO: 3966 - DNA, 1065 bp, Homo sapiens
gaaaatacgtaaatttatacctggaaaatatctgaaaggttatgtattaaactgttaacggggtggattggtggcttatagggtagggggctaggcattttcacttttaatacctgtattttttttgaggatttgttttacttgggtgtcacattcataatttttaatcctttaaggagaaaaatgtgcttattaaatttttggtctctgaatgctaccaagtcttagtcatacagaacaatatgctgcaactgtttacaattcctaaaactgtaaactcctcaaggacttggaggctaaacatgaagaatataaaattaagttgacaatcactgtctcctgcataacactgacttcacttctcttgagaaatgtgcatctgctaatccatatttattactttttaggggtgggtgaacccataaataagatactgttctttgaatgcctttagctggtgttatttaccagtaatgcttgggagaaagaatccaaaattacccccactaaaatgctcacgacccagttgtttctgtgtttgtcaaagtgtttctggtatattctagaatataccaaagataattacttgaatcatttagaaaattttacattatatcctcttataaggcacttggaaattcaccctttttttttttcggcttggctttctaaatgtactttaacatcaatttataatattaagagttcctaaggagagagatttcttagaagaataatcgtgtcttgtcttagagccacagcctttcacaatctgaagtgaatggtgcagagagctttcttgtcaagtcatatgtttcttcctgcagctcggcttgcccttcccctgcttgtgccgtgtaccctgtaacactgtgtttggatcccagcatcagatggtgagttctacttttggtttgtaaaatcatgtgggattgtgttttgaaactgcctttcaaatgaagttctttttgctggcctccagataattagtaacttactgatgtattgcttggacccttgcattgtgtaatatatgcttctgttaatatgtgaatgtccatgaag

SEQ ID NO: 3967 - DNA, 1243 bp, Homo sapiens
  misc_feature (1)...(1243): n = A,T,C or G
cgagcatctgcagctggcagtgtggagccaggcctgcactttgatagcgttttgggcactgaatagcagctctaggatttgagtctgaagggtcttgtgaacagtgtgggatggcggcagcagcggttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatacaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaagctgctctaagtaatcagacagtcaaaagagcaggaatcagctctccaggaggctctttggtctggggccgaggggatgagggtgggtcctgaagacgtctgagtcccttgttacaggagggtgttccattgtgtcctcctcacagctgggagaacagctgaagcagctggtgcctgcaagcgggcctcacagtcatggactctggaagctgaggggcacgtggtttgcggtttcagccctttgatgaccgcagcaggtaaaaccaggcttggtggacatcccttgctttttgttctggggctgctgggtagattagcttgcccttatgatactccattctcctagagttattagcagctctttttggaggggcatttttcttttcttttgggctaaatttaggtagattagcattcccatgtaacttaccagaatcagaatgagaattcagaagtcacctgaattgggccgggcatggtggctcacacctgtaatcccagcaccttgggaggccaaggcaggcagatcatctgaggtcaggagttcgagaccagcctggccaacatagtgaaatcccgcccctactaaaaatacaaaaaattagccaggcaccctgtccacagcccccacacagactcgaggggcccccatctcctgttctgaacccaacagggtggtcccactntgggaccacaaaccaggtatgactgtttnagaagcaggctcactaccagg

SEQ ID NO: 3968 - DNA, 658 bp, Homo sapiens
  misc_feature (1)...(658): n = A,T,C or G
agcggccgcgcacgaaacgggtccactggcggtcagcggcacccatgctgggcgatggcgtaccagtgccgtggccgccgtcagcgccaccagcagccaccgcgcccaggctccgagccgcagcacgcgccagcgcccttccctgtgccaagtacgggcctcggccacgggngaagtgcacggcgaacagcagcaggcacaccgaggtgagcagaggcagcgagaggcccgcgctgaggcggcgcatcgcaaagggggcggacgcctgaggggcggccagggcgcggccggccgccgggaactcgaggcgcagcgtgacggcgggcgtgcagccccacggccgggctgtagcgcgtgagctccaggaacacagcgcggctccttgtttgtttcagccaatttgttgcaactgaaggaagcgcagccggtcgcggttcttcctttcagactcatggccagcttcttgcacgtagccctcgctgtcatacacggcacaggagccccaggaccatgcccccagcagatccggcgctgaataggcccacgtccccgagccattgtgaggactctcccagccaacgtcgttatcgcttgtgctgaagcctcctgcggcccagcacgtggtggaccctggggccggaggggtctggtagagtgc

SEQ ID NO: 3969 - DNA, 1498 bp, Homo sapiens
ttttgaattgttttatataatttattcttatttgtgattacaagtatacctctacagaaagttagtatactcacacaaaggcaacttgtgcagaaaagaatgttaaatgttgtaccgtctcaagaaaccccaataatgataattatcaaattacccaatttttgtgaagatggggttttgccatgttgcccagggtggtctcgaactcctgcaccaaagtcagtctcacgatgacgatagacagccagactattgataacaggggtgggctgatggctgataaatcccagcaggagccaaatgaggagccaaaagcgcacgcgcatgtcctggtcctttcagggcgccctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaatcagagggagacaaaaaggttctgctatccaccaaaccttcttcggtctgggccctcccttaccaaccctggggctttatactccctctccaccaatccctgatgaccccggtggtgcctcacaatggacagtgcctcacaatggacaatgccaagtagcgcccgaatcattccaatgacccctcccccatctaagtctcccaaattcctcccaaagacaaggtcttctcttggaaccttcacaaacccgatttctggtcctccccaaaccagcttccctgtccctggcttctgggcgctccttccttcctgagctccccagggttccttcaagggtcacttttggcgacaaaacataaaaaacaaatgatggcaggatggcaggaagaacctcatacccaagcagagtgcccaggttttacagcctccgctcagccatttcatatcctaagacaacaaaacatcaggcagggtgcgggaaggtcccggatagtaaaccatctccatcacatccatgtaggccatccgtccatcaacctgtatcttggggaacaaatgtaggatacattcattttaagcatgcatggtacattttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctataatcatcttactgcctgtgtgtgtggacttta

SEQ ID NO: 3970 - DNA, 2022 bp, Homo sapiens
  misc_feature (1)...(2022): n = A,T,C or G
tttttttttttttttttttgacagagtctcgctctgtcgcacagtctggagtgcaatggcgtgatctcggcccactaaaacccccacctcccgaatccaagcaattctcctgtcccagcctcctgagtagctgggactacaggctcacaccaccatgcccggctaatttttgtattttcaagcagggacgaggttttgccatattggtcaggctggtctcgaagtcctgggcctcaggtgatccaccagcctcagccccccaaaatgctggggattacaggcatgaggtcaccatgcccagcctaaacttgggcaagataataaatcacctttttaagtgtcgttggggcacttgtctgggttgtttttctttaggttaccatgccaggcaatgattccttttgaagtttctgacagaagatagtggttttcatccaaataagtcaactactctaccccatccctaagccacttgtatgggaagaaaaagaggaagaaagccagtactgtgaactgcgtaagcttcccccagcatcacccgcctatgagatgtgtgggccagcctgagaccccggggaacctgcctccaaaggcacccaggcccccatnctgtcctgcacctcactcacccttccctcaggtaactcgccatggggccatgtccactgaactttaacatgcctgctgccagctcccttggtgagctggcccctggtcatgggacaggaactgtggggtcaggacaatagagagcttcacccatttgcagaatgagaacaggggctcatgatgagtgccaacctattagataatttaaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaagatttcacgagatcatacctataaaacatccaagtcatttaaatgtatcatcatttctgtcataattagtgggatccatttcactattattggatatacagttctgtgcctgaaacctacaaaaaaacaaaatgttaagtctaaaaagcattagtgatttctcatttttatattactaattataaccctatttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggtttctgctgcatctgccttctcagtgttcacctaaggacttttgtattttcctcctcgcatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccggagagctgtgacttctctgtgccctgggcccaaactatgaagacctgacacactatgctaaaagcccaacgctgggtgctccccagagcctcttgcctcaccgcttctgctgaggggaggaatg

SEQ ID NO: 3971 - DNA, 1021 bp, Homo sapiens
tacatctccatctatctccctctcccctcagaagagggtgctctttaagcatcagccatccggcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagaatttcccatttaaagtgacgaaccctcatactccatttgtgataaatagcacaaaggttaaaaaaacttatttttgaccaaaagctctgttgacattctattaaacaaacaccgacctatttaattttcataatgcaaatggcagatgttttcataattcttatactaataaatcatttccctgattttttgggtaaaaccacatattcataatgaagtccagaaatgtgaattgttttatataatttattcttatttgtgattacaagtatacctctacagaaagttacgtattaactcacccaaaggtaaactatccagaggggtaatgacaactttataacttgtcggaaacgcaataatgacatgtaaccaaggacttccaccaaagtcagtcccacgatgatgatggtcagccagagtattgataacctgggaataataatagttggaaataatgaaaaaggtcaatgacaccgacaatatttcactcagaaagaatcaatccttagaaaccgtcaacctcctcccaaaaggtaaccacatccctcagatatcaccgtgggattcccactgctacaaaaaagaacagaagttagagaagtctcatgtttttcagatggctggtagtgtttttaggcattgcaaatgtggggtgttgtctttcttggtataaagcagggatatccaatcttttcacttccctgcctatattaaaagaaacaaagttgtcttgagccacacataacatacactaacactaacaatagctgatgatcta

SEQ ID NO: 3972 - DNA, 2380 bp, Homo sapiens
atttttatattatttatttattcttcgttagtttgtttttggagcgtgggttttgttttgttttttgatttttttctttttttccgacccacggatttattcttattgcccaggcttgaagtgcaatggcgtgttctcagcttactcaacctccgcctcttgggtttgggtaattgttgtgcctcggccttccctcttccttcttgggcttgggccgatttttccaccttcatcccgcccttccgcctcttgggtttcggtgattgttccacctcatcccacccctcccaccctccttgggtttggggtgggtttttccgcctcggccctccctgaataacctaagggaggaagtccttgaagattatcatcccactgaagggtggaagaggagagggtggaagagggacaaagagacagtcccttcagattatccatccactgagggtggaagaggagagggtggaagagggacccaggagacactccttcagattatcatccactgagggtggaagaggagcaagaggacactccttgatattatcatccacggatgggtggaagaggagacgggtggaaggggaataagaagacattcggggaggtgtcttgaggctcagggagttatcagttatagaatgttgttgagttggaggaggtgggctggtggccccatcctgttttttaaaagtttcagctgtgaggtaagggcccagcagggcaaatcctgaagaatgaatgaatgctcccgtgccgccattctgacctgtagggcccaaaggagggaaatgttttcacacatattcatttgatggacaaaattaccgccacccaacacagtctgcaccttctgttgctggtgatagatttttgcacctttccatcctccaggtttcaaaatagcagtgtcagtgtcataatatcacccttccactgagtactgccgacagctagggggtaaagaaaagtctttgggacacactgttgtctccacatgccactgtgtctgtctgcaaatgtaggcaggctggggtcctgccccagggaagacagagtcataacagagtaataaagaagctatgtttgagacacaggagtgtctatgtctatcctcattcctccctcaaaagccatcaccagagcatgtttcttgcaccaggtcaatagacagtaagagacagtaagagaggcatgaaaagcccattgtccacacatgttgcagcttctttttggagaatgttttccaggccttttatgttctgtctctgattctcagaactctgcaaggtcagtgtgaccatcctgcttccaaatctaagaaaacagaggtttccagaggaaaggaagaaattgtgccccagggtcacacagcttgcaagaggcagagtggaaagttgattcccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatcttacctcaagaagtcagttaggcatggctgtaatatttccttttcactccccaggtaatacccaaattgtaagtgcactaggacataaagaatacttttgtcccatggaaaaatgaggtgggaattcctaaacaaagcaagttttaaaactgtgtttcacttcaagtgtacaagtcccatcgcgtgtaatcataggactcggcagcttttgaaggtacagaggccacacaagaacccagcttagctgagcatcatttaaggccttcatttgggaattgtcccctgtgggtaataagttacattcactcttcactaatttacaagtcagggcccattttgcttattacaaatatggaacctctgacactttgaatattagatcaggggcccccactgggtggggatgaaggtgtttttgcacaacacggttaccaacagggatgggactgtgatgcttgtaggcagccttcctctctgccatctccctctgcagggcttgagcacagagccgtagggagaaaaatgtatccatgtcctgacctggcagactatgtccaaaagcaaggaaaacaagcaaacttacccggttgcaaagaggctttcttgcagaaggggtgattttgcatctgtagtagtcctctgcccgccgccgcaacgcttgcgcacgttgaaacattttctgttttctggcggtcttcctctttccattgattttgtcatgacggttgattttcgttgtcaccttcctcttacggattttagctctaacttttgtttccacatgcctccgtagagtaatgacgtctttcag

SEQ ID NO: 3973 - DNA, 1579 bp, Homo sapiens
ttatttttatattatttatttattcttcgttagtttcttcagattatcatccactgagggtggaaggggagtgagcagacacacttgggaggtgtcttgagattatcatccgctgagggtggagctgagggtggaaggggagtgagcagacacactcgggaggtgtcttgagattatcatccgctgagggtggagctgagggtggaaggggagtgagcagacactcggaggtgtcttgagattatcatccgctgagggtggaaaggggatagagcagcacactccgacaggtgtcttgaggctcaaggagttataagttatagaatgttgttgagttggaggaggtggcctggtggcccatcctggttgttcaaagtttcagctgtgaggtagggccagcagggcaatcctgaagaatgacgatgctctgctgccgccattctgacccggttgcaaagaggctttcttgcagaaggggtgattttgcatctgtagtagtcctctgcccgccgccgcaacgcttgcgcacgttgaaacatttccatgtaggtgtgtatttctttcatatccaatttcccgttttcctctgcctctgacacctgcctctccttttcttcgtggctcacgttctttcatgcttagtttcctcagatgttctttggcggtcttcctctttccattgattttgtcatgacggttgacttttgttgtcaccttcatcttacggattttagctcgaactttggtttccacctgtctccataaagtaaagatgtcttcccaggacaattttaattccttcctgtctacggcggttggacctccctggctctctgctgtacatccgtggatccatcatgtccattttgagacgggaagatagtcttcaggaaagacacacaaaggtaacttgtgcagagggagatggcaaatttataacttctcagaaacacagtaatgataagtaaccaaggacttccaccaaagtcagtcccacgatgacgatggtcagccagagtattgataacctgatttctggtcctccccaaccagctccctgtccctgcttctgggcgctccttccttcctgagctcccagggttcctcaaggtactcctaggaataatcacggaacaattcccccttatctgttcagcaaaaggccggctgagaagggcacaggggtctttaattcaaactgcgccaaggcggcaggacccccagtagagccctcacctcagcgtggaggcctcagaacgtgaggaaggagctgtccagcacgggttgagtccaggcagctgtcgacgtccagcacctgctgcccggcaggtgtggggctcgggctcccagccaccttgctccgggacatccggaagagaaagaggatggccaggtagacgggatagtcaaccacgctggacaccaggccaacagcgactgtgtcgacgctcagcgggttcagcctggacacacgccccgtgctgtaggcagagtctccaacagccccgtaccacacggcgttggcgcccaggaagagacagatgaggagaacgcagcaggtggccctctggatgtgagt

SEQ ID NO: 3974 - DNA, 1188 bp, Homo sapiens
gaattcggcacgagaaaaccgagggcccgcagggtaccccgcggccgccgcgatgcagaaatacgagaaactggaaaagattggggaaggcacctacggaactgtgttcaaggccaaaaaccgggagactcatgagatcgtggctctgaaacgggtgaggctggatgacgatgatgagggtgtgccgaagttccgccctccgggagatctgcctactcaaggagctgaagcacaagaacatcgtcaggcttcatgacgtcctgcacagcgcacaagaagctgactttggtttttgaatttctgtgaccaggacctgaagaagtattttgacagttgcaatggtgcacctcgatcctgagattcgtaaagtcattcctcttccagctactaaaagggctggggattctgttcataagccgcaatgtgctaacacagggacctggaagccccagcaacctggctaataaacagggaatgggggagctggaaattgggtggattttgggcctggggttcgagccttttggggatttcccgttccgctgttactcagctgaggttggtcacacttgtggtaaccgctcaccggatgtacatctttggggccaagctgtactccacgtccatcgacatgtggtcagccggctgcatctttgcagaacttggccaatgctggggcggcctcctttttccgggcaatgatttcgatgaccagttgaagaaggatcttcccgacttctggggacgcccaccgaggagccagtggccctctatgaccaagctgccagactataagcccctatccgaatgtacccggccaacaacatcccttggtgaacgtcgtgccccaaactcaatgcccacagggagggatctgctgaaagaaccttctgaagtgtaaccctgtcccagcgtatctcaagaagaagaggccctgcaagcacccctacttctccgacttctgtcgcgccctaggcccccgggacccccgggctcatcaggctggggcctggcctatttaagccccctcttgagaggggtgagacagtgggggtgcctggtgcgctgtgctccagcagtgctgggcccagccggggtggggtagcctgaagacacgaatatctcactccctttatagagaataaatttaatatcataaatagactcctttcccacaaaaaaaaaagg

SEQ ID NO: 3975 - DNA, 5655 bp, Homo sapiens
  misc_feature (1)...(5655): n = A,T,C or G
atcgcaagcggccccctttttttttttttttttttttttttttttttttttttttttttttggcagccagacagcttttttattgactttgtctgcttggggcgggggttgggggggtgtcgaggctttaaaagcggccatgcccacagaaggggtacacaaaagcaggcacagccagctcccgagggccttgaggctgcctgggccatacagcacactcgcgcgtgcgcgcgcgcgcgcacacacacacacacacacgcacagtgaggttgctccaccctgggagcacaccccccaagaagaatctttttcttctaaccaccctggggtcctctgacatgcctaagtcctgctacttgcccagacctgaatgccagcatggcctgggcgtttgcttctattgctaacctgggcctgggggcaaagggaggatgacaaaggcctttgggggtgatgaagagtgcctgggaagaaagtttttgccccccagcaccgggccnaaggccaagctcgcatccaagcagcagccgggcttgccataacgcccaccacacctaccaagcgcagccaggtgttgggggaggccagctctgggcgcaggcccctcagccctagtgaaaatagtgacatacaaaaatatacacattttaacaccatataaattactgacacgagacacacagtgagacggtgcagggagtacggtaggaactggagaggtaataacttaggggcagggtggcggcggtgcaggctaaccctcccttgaagccaagcaagcctttagcaagtgggggacatcttgcccagggggtgggggcccgggcacagccccgcttgtacctgaggactcggggaaataaattagcatctcagaggctagaaaccgtccaatactgctgtgtccttcccaagggagctggggaggggaccctgggtcctggttggccacacagcctctttaaagtgctgaagcccacagacagacagatgcccctgcctgctctctggggaacctacgtgcagccattctgcctggccctcggccttgacagcggcagaaagtaatactgagcggtgtccactccgactccacggcccacccccgccaggaaggaggactaagtgctgctggggtggaccttgttcttggcccgaaggggtgtcctgctggggccagtggccaggtccacaccccgactggcccgggcaaggcggctgggcagtgctggccgcaggcccggggatgggccacgggaagatccggcgggcgcccggctgctcctgcggccttgcaggctgtgcagctgctgctccagctggtagacgtcctctgtggcctggttgagtcggtcaaactgggtgagcagggcctcgaacacggcttggaggcgggagggctcaggctcacaccttgtccccagccggcccaggctcacgctcagcccatccagctggctggaggaggtggaggggtgcgaggcatcggagccagcgctgggtgggggcacatccggggataccttggagcccctggaggagcgagagggcagcggctccatcccttcaaagcggactttgtggcggaactgggggcggcacaggggctcagtcagtccggctgcaccctgggcagagcccagggcgtgtccctctcccccccactgggccgtacccacctccttgaccttgctgaggcccatccagaggcgcagcctgcgcaggaacaactccaccatctcgtagtcctggggctcccaggccggccggtacagctctccacgcaaggcgtggtagcgccagcggagaataacagcccccagccgtagggcgccccacagccgcagtgcccagagccccacacacagcaggggtgacaggtgccaggactcggcaggacacagggtagagagcccagtcccagggcacagcaccaacagggcctgggccacgctccagagggagtccacacaggaagacacgagctgcggggaaggcgacaccagtgagggcgtacagctgagctgagctgagctaagacgccctccccggccgcgcagtcacctaccaggatggccagctgggcgtaggctaccccgagcaccaccaggcccaaggtgacccccaggagctctggcagagctcggcataatgtcttgccaaagacggaccactggcgcacgaagcgtagctgctgggcagcctgcggacgagaaatctgtctgcttgcagccctggggtgtgcgcccagccccgcgcccaccggcccagccctcaccttgaccaaaagcaggaagagcagcgaggccgccaggccacgggctgcggagctcagctgcgccacctggtcgaagctagtgaagcggcgcgggcggccgcgcacgaaacgggtccactggcggtcagcggcacccagctgggcgaggcgtaccagtgccgtggccgccgtcagcgccaccagcagccaccgcgcccaggctccgagccgcagcacgcgccagcgcccttccctgtgccaagtacgggcctcggccacggcgaagtgcacggcgaacagcagcaggcacacctgtggggggcgcggtcaggagggcgggagggacgctgcgagggggcggggcgctgcgaggggtgagacgctgccggggcggggccccgcgagggggcgggacgctgccggtgggaggcgcggggtctggccggggacgggcgtaccgaggtgagcagaggcagcgagaggcccgcgctgaggcggcgcagcgcaaaggggcggaccgctgagggcggccagggcgcggccggccgccgggaactcgaggcgcagcgtgacggcggcgtgcagccccacggccgggctgtagcgcgtgagctccaggaacacagcgcggctcctgcgcagagggtgcgggtcagtaggagcgggtggcagggcgggagctgcggggaccgcgcagtgcaggcgtggctgaggggctgtggaagccgcctaggccagcgggggccggaggagtgagggtgggctcctggctggtgactgcggccaccccggagagggcaggggagggagctcccacctgttgtccagccagttgtgcagctgcaggaagcgcagccggtcgcggctctcctccaggctcaggcccagctcctgcacgtagcccccgctgtcatacacggcacaggagccccaggaccatgccctgccggagaggggtggcgtgggtgccgcaccccagcccttccggcaccccggagccaggctggtcaggaggccgcggcactcctggagaactactcccttgtccttggcgtagacgccggggccctcgctctgctcaccccagcagatccggcgctgaataggcccacgtccccgagccattgtgaggactctcccagccaacgtcgtaatcgctggtgctgaagcctcctgcggccgagcacgtgtggaccctggggccgggagggtctgggtagagtgctgaaacacacagagccccaggccggggccagggcctcatcaaaacccaacaggagtgtttcctgctggccagctcgcctgagctctggttcggcgccaccccagggaaccctcccagcagccatcaattagacaacgttaccatctctcatatacagagaaggaaacggcggtgttaagagggcaaaggtcacacagctagggagcagggctgatgccagagctccgctaaaggctgctctctcaacaagaggaacgatttaagtcttggggcacgccctgccagctcaccttcctgcagccgcacctgccgcagccgtgggggccccagctctgggctggactggttcccgtggacgtagggcagcagcacgtgggccatccatggccagagctcctcagacctgccacagcatcagtcacacgctccagcccctactgccccatgcccgcctcgagtgagcggccaccagagacccagggaacatggctcccactgccctgctggccacggctagacctgggcttctcagccttatcctggggatgttctggggcagacagttgtctgtcatgggcccgtcctgtgcactgcaagacacggacctgtgtccctcccctctgcctactgatgccagcagcacctacctccagttctagcagccacaaaggtatctacacatgtccacatgtcccctagggtctggctggactaaaggcaaaactaaagcccagaagacagaccagtgcaccggatgcccgtaccgcgtgatggccaggaaggcccggctgtgcagctcctgcttgatggcgctttgcagacggtaggcgtgcccatggcatgaggcatccccatagctggccagcagggtcaccagcagaaaaagcatgtacaccaggaggctctggtggacgggggggccctgtggtcagcctggccccagcccacagtgacagcagggctttggcaacggctggagccatggctgcggcaggtgtggctgcaggaaggtgagctggcagggggcgccccaagactctacctggccagggtaatggcagcacacaccctgcccggaacccacctgggggcagacacacaggccactgcagtgtgcttaggggccttcagggccaggcaggagtgggcattggagctgggccctggcagggactggggcagcaagtgggggcgtggggtaggaggtacaccgggtacaaaggctgcagagcattgaaccctaagggccttctgaggtgaggaaaaggggacacaggagtgtcctgcgtgcatgggtgggaggtgggagacaagagacggaggtggcaggggcacaggccgcacccaggctcacccgcagcatgccatgtagcctcttgaccttgcgggcttcttccttggccaggaagagtgcaaagccgtggggtggccgtacgcggggcacacgtgcgctcacaggcgtcacagccgggctctctaccagggtgtcatcttcatccgggtgcagccgcttggccaccagtgagaagtacagggcttccagcaagacctggggagggggtggcttcagaggggtcccccgtgatggaggcctgtagcctacccctggcagccccctcaccttcagtggctcccagccgaggaatgaggccaggaagctggcgctgctggacaggagccacgcaacactcacgcccggggggaagctcgcacccacccaccctgagacagccacagccacagccaccaggagcaggctgagcccgtgggccagggaggcacaccaggccggcagcaggcgcttccgcagaccctccaccagtcctggggaagcagagacagacctgtgagaggcagctcacagggaggggtctaggggcatcccggggctacgcaagcacacctgtcctggacagcctcgctgcctggggctgttcccagttcaggcctgggctgggtggccccagctcccccagcctctgcagcgccagcgtctctgtcttctccccaggagtgctggacctgagggacatggtaggctgtgaattcatcccggcctccaggaggcagttgcagccaagcccatgttaacctgggcgggcagtttcttgagcctcttgggtcacagggtccccccgacaaaaagccggaagaccctaccccaaacgagagt

SEQ ID NO: 3976 - DNA, 1234 bp, Homo sapiens
ttttttttttttttttttttttttttttttttttttttttttttttttttgcctttgccaaaataaggttttattttgaaagtcatttgatgaaagtcatttgaaaggccactgaggagggaaggaggccttaagaccccaacagatgtaggatccagatctggattccgtgccagcccccacccaatggtctgtcaggcccaaggaaggtgctttctttggtaattcatgtttttttaacttcctggagaagagatcttttcccacaaagccatcttcatttttttttgaagagtaggggttttatttccagaaaacagtgttgttgagctggagatgggttgttttttttaaaaacatccaaggttagatctaattatgttcaaccaaagtgggggtggctccagcccagaagcgaaagtgggaaagattcgtctagtatttgcttgttcatcttggtggcaaccgaaaatcccacatgtggaaatgggtgtcccaggagtacgggtcctattacgaagttgtttcggtctctgcatcataaatggctaatcattggtcctcctgcctaaagtttccgcgcagcacgaaagcttgctcctccggaccccgaatcttgaaaggatgcttctgtaaatctctgcagtcttaatgttgacagcaatgccatatattactggaaagtgggttttcgttttcttccccggtcatttaattctgtccacacataatgtcacctaagtgaatgtcatccttccttgccctgtcaaattcacctaagaagttgatgagtgagtttttgtgacaactgcctgtccgtcactgaagcctccaacaaggtgtacttccagcctatgagagcagcgtagatctcaccttccacattgagcgtggtcagaaaaggattttatggagttcatgatcaaggggacctcagctttggtgtcggttccgtcacaaatgtgtcaagcaggtggccccattacctgtgtgcctcaggaccacaatgtgacaagtagtggcatcatcagaacccagaatggagatggagccatcctttggggaggtcactgcaagctctctttgctgaacatacagaaggccctggggtcccacttgttgaacagactgacctctgagaagtctggctctttcctccaaaggcgggtgggctcggacgaggtccccggctgactgcggcagccgccactcaacgcccctcgacgagcagcgg

SEQ ID NO: 3977 - DNA, 5538 bp, Homo sapiens
atttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcagcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagtgtggaaggggagtgagctgacgctcggaaggtgtcttgagattatcatccgctgagggtggaaggggatagagcagacacactcaggaggtgtcttgagattatcatccgctgagggtggagctgagggtggaaggggagtgagcagacactcgggaggtgtcttgagattatcatcccgctgagggtggaaggggatagagcacacgctcggaaggtgtcttgatattatcatctgctgagggtggagctgagggtggaaggggagtgagctgatgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatcggctgatggtggaagcggaatccgcagacgctcagcaggtatcttgatattatcatctgctgagggtggagctgagggtggaaggggagtgagctgacgctcggaaggtgtcttgagattatcatccgctgagggtggaaggcaggtgtcttgatgttatcatctgctgagggtggagctgagggtggaaggggagtgagctgacgctcggaaggtgtcttgagattatcatccgctgagggtggaagcggcccccgcagacgctcggcaggtgtcttgatattatcatctgctgaagggtgaagctgaagggtgaaagggaagtgagctgacgctcgaaaggtgtcttgagattatcatccgctgacggtgaaagcggaacccgcagatgctcagcaggtatcttgatattatcatctgctgagggtgaagctgagggtggaaggggagtgagctgacgctcggaaggtctcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatctgctgagggtggagctgagggtagagctgagggtggaaggggagtgagcagacactcgggaggtgtcttgagattatcatccgctgagggtggaaaggggagtgagcagacacactcgggaggtgtcttgagattatcatccactgagggtggagctgagggccgccggggagtgagcagacactcgggaggtgtcttgagattatcatccgctgagggccgaaggggatagagcagacactccgcaggtgtcttgagattatcatccgctgaggggtagagctgagggtggaaggggagtgagcagacactcggaaggtgtcttgaaggctcagggagttatcaattatagaatgttgttgagttggaggaggtggctgggtggcccatcctcgttttttaaagtttcagctgtgaggtagggccagtagggcaatcctgaagaatgagcgatgcttcactgccgccattctgacccagttgcaaagagcctttcttgcagaaggggggattttgcatttgtggtagtcctctgcccgccgccgcaactcttgcgcacgttgaaacattttctgttttctggcggtcttcctctttccattgattttgtcatgacggttgattttcgttgtcaccttcctcttacggattttagctctaacttttgtttccacatgtctccgtagagtaatgacgtctttcaggccaattttatttcctcgaaaggaagaaactcttttctttgtgtgcatacaaatggacctcagcccttcctgtctacggcggttggacctccaggctctctgctgtacatccgtggatccatcatgtccatttcgagaccagaagatagtcttcaggagagacacccaaaggtaaactatccagagggtaatgacaactttataacttgtcggaaacgcaataatgacatgtaaccaaggacttccaccaaagtcagtcccacgatgatgatggtcagacagagtattgataaccttcctcaggtactcgcatgggcatgtcactgactttacatgctgctgcagctccttggtgagctggccctggtcatgggacaggaactgtggggtcaggacaatagagagcttcaccatttgcagaatgagaacaggggctcatgatgagtgccaacctcagttttcttctgtgtgaaacaggaacaatagtttcattcgtcattcagtttctctcaagatttcacgagatcatacctttaattttctccaacaactgattctggtacacagtataccttaatgcctgcatccacggcctcacgtcatgctgtttacatgaacgtaaagcttcgccgaagagtggaataagacagtcctctgttgaaagtctgttagaaactgtggtctccaaagcagacgagcaatacagctgcaaggtacttagaactggcaaagactgtgaaactgttaaagtagaaagtctcagaggtccaatagcgatgcgggatgtttgcttcaagtactttaccacattttcagttatagactgccacttctgatcttgttctatcgggttttaaagcagttgccaaacaaacagaacttcttaacaatggaacttcaatggatttctgaggttcccttggatctggacttcacatgttacgaagcagttttttcatgtctattttttcttttgatcctccagcaagtagattgatattttcgtcctggtaacaattctaattgctcgggtacattcgacaaattttccagactcaaagctgccttaatggattttatatagttgaagtcagctttcaggttgagggaagtgctactggtactctttttcaagtcatggatagcgttctgccatttcctgcacagcagcccaatcggctagttgatatgtagcactcacatgctttgtttcctaaataatttaataaccctcagggggaagagtcaagtcgggtttgggacagcacactttttctgggattcacccattccagacaatgtttccaggctgggcactccttacaccccagcactgggctaagggtgagcacccgatttgtcaaagctgggagatgcagccaatcaacacctgtcatggggcacacagggtgttccctggtactccacagaggccttttcaaacctcccttcagcctgttgagccactgagttaatccacagaagatgttttccaacaatagatgatgaccagacagcaattccctgtatagcttcaggacaatgaagttcacatagtgcttctaccaccatcataatgcttacttccaattcattcccctgagataggctggttgttttcatctctgtaagcaagtcaaagccatgtctcactgtcactgcaggctggcctgccaacaatcctaccctcatgatggagagtcgaatccgcgttagccagtcctgacaagtttggcgattggtatacaaaaaagttctaatgaccttgggaggtgaagttaaggcattagcacatccctcgtatgcattatacattaatttctccagattttccagatactgcagaagaagaacaagtctaagttggttgttaccatggccttcatcactgtctgcagttgtccactgactaacatcctgatcagggtttaatgtgtgacctgcgagacttcgaatgataccttcaattgtctggaaggtgtcttgagctctgcccagtggggttctcagcttagaaagaacagtgaattgtgcagcttcccatatggcccactgccaaaggatagcatctgtcttcaggagattgcgtggaattgttgactggtcacgcttatccagtctctggcagctatagaacagtctttccaaccaattgtccttccctgttctatgagagttcccatacaaaataaaactaataacatcagagaaatcttgggggtggaatgtattacttggtgctttactcatgtgacttcttaatgctaaagaaatttcttgaatttctgtgtgattgttatcgcttaggaaaacacctaaaggaattgatttcaacagttttccaaatgcttgtcgaatacaagttccacggtgcactagttggacacggcaaacatcaacacatctctgtaaaagatcatctggcaaggaagaggatagagcatgtagactgctgcatgcctgcagacagatattcacatcttcaacgagagtgtcggctaaaaggcctttgcaaaatttatggaaagacggaagacagaataaaggtgcatatgtttcggacttcttcattacaacagctacttccaaagcccaagtcattaacagtttcctcgtgtcctg

SEQ ID NO: 3978 - DNA, 4072 bp, Homo sapiens
  misc_feature (1)...(4072): n = A,T,C or G
ggggcgggcgcgggggacgtcagcgctgccagcgtggaaagagctgcggggcgcgggaggaggaagtagagcccgagaccgccgggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccagagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaatttttcagatatgaaaatgggtgtgcttatttccacgaagaggaaagagaaggacttgcaaagatatgtaggcttgccattcattctcaatatgaagacttcgtagtggatggcttcagtgggttatataacaagaagcctgtcatatatcttagtgctgctgctagacctggcctgggccaatacctttgtaatcaggtaatctcggcttgcccttcccctgcttgtgccgtgtaccctgtaacactgtgtttggatcccagcatcagatgggatgtttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagcccaaaatgtgatagcatgacagatgtactcctggcccagtggcatggtgtttgccagctgtttcctgcggtgacactgtataaacacgatgaccctgccttgactttagttgctggtcttacatcaaataagcccacagacaaactcccgtgcccctgccctctgtggttaatcctttaacaatacttggggaccttgatgggtttgtggagaggatcaagcatgccctgtcaactgagtcaacggttgcaggaaagtttgaagaaagtgaattacatcaaaatcttggtggaagatgagctcagctccccagtggtggtgttcagatttttccagggaattaccagggctcagatccggtgtttaaagcccgtcccagtgcccaacatggacaccttcaggagttcggccgggagaggcactcgtgttgacgcgctgaatcgcttggctgggagaacagcttgaagcagctggtgcctgcaagcggccttcacagtcatggatctgggaagcttgagggcacgttgttttgcggtttcagcccttttgattgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaagggaaaaacatccatgctggactcctgaagaagttaaatgaactggaatctgacctaacctttaaaataggccctgagtataagagcatgaagagctgccttttatgtcggcatggcgagcgacaacgtcgatgctgctgagctcgtggagaccattgcggccacagcccgggagatagaggagaactcgaggcttctggaaaacatgacagaaagtggttcggaaaggcattccaggaaagctcaaagtggagctgcaagaaggcaaagtgaagaacggcttctggaagagggggtgttgcgggcagatccctgtagtgggctccgtgctgaattggttttctccggtccaggctttacagaagggaagaacttttaacttgacagcaggctctctggagtccacaaaacccccataaatgtacaaagggcaagggtgcagggagttcacgctgcctccaacgccccctcgggccagttcgcaccaagcagaggctttccagggccagaagcccttttaaaaggttccctgcgaagtttcagatgctttgagtgagaccagctcagtccagtcacattgaagacttagaaaaggtggagcgcctgtccagtgggccggagcagatcacccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaaaatgaagttctattggaaatgtgaactgtgccacatactaatataaattactgttgtttgtgcttcactgtgatttccgcacaaatatgtgcctgaaaggtaggctttctggggggggagtcagcttgtctaacttcatgtacatgtagaaccacatgtttgctgtcctactacgacttttccctaagttaccataaacacattttattcacaaaaaacacttcgaatttcaagtgtctaccagtaggcacccttgctctttctaaacataaggcctaagtatatgaggttgcccgtggcaactttttttgggtaaaacaggctttttcattaggcacttctccagggttctctggcaacactttcacagaggcgaggactgggctgttatccttttgctgttcgggtctttaggtacggatccaagttgcaatatacagtgggactgctaagacttgaaggagagcagtgaattgtggggattgtaaaattaggagcatcagaaagcccctcccccagctactggctccttccgtgggaagacttaagtaaaggacttgtggtctactttgaagctgttgggcaaaggctgctggtcttgggggactgtccctcttggccaacaagggccattttctcccattattataccgtttgtaaagagaaactgtaaagtctcctccttgaccatatatttttaaatactgggcaaagcttttaaaattggcacacaagtacagactgtgctcatttctgtttagtatctgaaaacctgatagatgctacccttaagagcttgctcttccgtgtgctacgtagcacccacctgggttaaaatctgaaaacaaagtacccctttgacctgtctcccactgaaagcttctaactggccctggcagcatcgcctggggcccaaactcagaaacaggagccagcagagcactctctcacggctgatccagccggggcaccctgctttaagtcagtagaaagctccgctgggaacttgcccggttcctactttttcccgaaggtantgcgtccactttgtccgtaagtaaatgccccctgtgcccttcttaaatcccagcagtccaagcttttggggagaccctgaaaatggggaaaattcacacctgggtttctgggattgttagtattgggaagccttagttattagtatgattaagcctattaattatactctgatttgatggggatttttggacatttacacttgtcaaaatgcagggggtttttttttggtgcagatgattaaacagtcttccctatttgggtgcattgaagttttagcaggtaaatggggggaggggtaaattatcaccttcaagaaaattacatgtttttatatatatttggaattgttaaattggttttgctgaaacatttcacccttgagatattatttgaatgttggtttcaataaaaggttcttgaaattgttaaaaaaaaaaaaaaaaaaaaaaaa

SEQ ID NO: 3979 - DNA, 35146 bp, Homo sapiens
  misc_feature (1)...(35146): n = A,T,C or G
ttgggattacaggcgtgagccaccacaccccggcccgggccacttgggaaggtttcttaaggggactaacttcggccttctttcaactttgctatagatgtacttgagatttttctttctggagtgcaatttcggaaagcgtgcaacagccgcgtgcttgcttcttctgagttaatctggcgtgctgctgtgcagttgtccgtggacgtctgcttagcgaagtgccctacgttctttcacattctggtgacttctgagtcttctctctttctccctggtcagtctagctaaggctgctcaagtgtgttgacccttcccgagcagcctttggtggacgcctttccctctggctgcagcactggaaagtggcggccctaggcatggtgccgaggcccaggctccattcccagtactcccgggtccccagccccagcccaccttgctccgggacatccggaagagaaaaaggatggccaggtagacgggatagacaaccacgctggacaccaggccaacagcgactgtgtcgacgctcagcgggctcagcctggacacatgccccgtgctgtgtggaggagaggaggccacacaggtgaggctgaggggcaggaagggctgggcaggaagaggctgccccgacccctacggcacccacctgtaggcagagtcgccaacagccccgtaccacacggcgttggcgcccaggaagaggcagatgaggagaacgcagcaggtggccctctggatgcgagtgaaacggctacgaggcggccggtcccatatggagagccagatgtgcttgtcaaagaagccacgctgcagctcagccaccagcaggcgcaggaagcacacacggcctgcgtgactagcggacagcacgtccttctccaccaggcccccgttggcctccgtctccaccgaaagacagtcattgaccaggaagaaggtgctgcgtgccgtctgcaggtccctgacgatgatgtgctgcaggaaccaggcagggctgagccctttgttgtcgtgccaacactcggatgttccacatgctacccaggctgtgcggggtggcgatgtggaagatgtccagactgatacaccccacggctctgtcgccgtccaggtgccggtggccgctccggctgtccaccccatacagcatgatgcccacgtgggccgtggtacctgagccccggccccagcctgtcttgacgaggatctcgtacttgaagcggccccgctgcccacagaaggggatggcgcggccccggctggcatccaactggtccagcttgtgcaggatggcggccatgaccatgtaggtcaccaggcacacagcacatgtcagcatgacgatgtagtttacatccgctgttggctcaggaaacacaaagcggatatggcttgggggcacgaagaggctggtgccgaaggcggtgaggtggcgggtgaggcagacggcctggcggggcgaggtctcctccgaggcagcagcccctctgtccgccacaccacgtcctcctcgctgaagtactggcacagggacgtgtacaagcccacggacacctccagcgccgaccagcggaagtggctggagaggttcagacggtaactccccactgggtctctggtccccggggaaatgaagaaggtgtagggccggtggtcggcaccctggagggactctgggcggatcctcctgctagccgagcagttgtgctcattgggccggggctccgagtgtaggtagactgccaggtagggctcaggttcctcagacaggtagtggcctggggcagaacgcgcaggtcacacgcctgccgggaagctcaaccacccgggggacacccacgatggccctcctgagcccaccctctgncacgggcctgaaaggccataggagcctctgcaccagagctggcacctgcttctccgtggcccccagctcctctctggccaggcccccagcagcccatgaaacagaaagcaaatttcaccagagacacccatggaagccctacgagaaacgccttccccccaagaacaaggccagggggccgcgtgtgccccacccgctgcacgcaccgtccagcagcgtatagttgagctgcagatgcagcccggccgcagggttgctgctgtccagggtgaccacagcaccgacggaggcctggggctggaccacaacggagttggcggagttggcggagctgcggtggccccgggcagcccagtccgagttgttgggcaccttcacggtgatggcgcgctctgaggccagccgctcgatggggatctgggcgccggcctgtgtctggaatgccatcgaggccaccttggtggagacggtgtagttgctgatatagccaaagggaaagggattggagtccaccagaaagatgagctgcaccacgtcactgaggttggccagggccccgctgaaagcctcggggatggagaagtggcagccaggccctggggcgccgccatagcacagcaggctccgcgggtccgagcgcttgccctgggccacgatctcctcgcccgccagcgtcaggggctcctcgttgagcacgcgggagcgcatgaggatgcgcatgagggcagaggtcaggttgtaggcctgggacgccaccatccgagatggtgactcggctcccagctctgagggctgtggtgcccgcacgtccgagctggccaggtggatgaggtctcctgtgatgttgaggatgctgtctccgatggcggtgggcgtcacggtgcccgcggtggtctctgcctgcaggatgagcatcatggcctccagcttgtgcagcgtctgcttcaggcacgagcggcatacgagctccctgctgggccccatgcactgggccagcgcagcagcgatctgctggatgtcatccacagtgtggaccctcagggacaccagagtctccgtgatgttcttgcgtatctgggctcggtgctgccgctcgtgcttgggctctgccgccacgttcagagcccgctcgtactggggcaggcagggggcacagcaagctgtcagcagcgcaggaggccggcaggaggccagcagatgcccacgactcccggggtgcagttacgtgctagacgctgtgtgatgcgggcactgacccacaacactgagctgtttcttcatgggcaaaacagggtaagcacatgggccctcctgggcgggggctgcattgtggaaagcagacgccggagagggcccggtgggtgtggctgctgggagcggaaggtcggggtgctgcttcagggtcactgggatttatctctggggcccgggatgagccctctgcaaagctccaggcaggggtacaggtcttggtcccaagcacgcatgcagcagatgtgacgtcccctcccaggctgcactcacctcgttcagcacggtgaccagggccaacgagtactcgatgacgtgctggggatcggcctgccgcagcagccctgggagcacactagcggtgagcccgtgcagccagactgtgagccccgttgcgctgccgttgggctctgggagggtgatggccaaagacctacgagcagaggggggtggtgagcaggtggcagtctcgggggcgccctcccacggcctggctcacctgttgagggcgaccacagcggctcccagctggtcctgcaccaccacggccaggcccacctcgaagtgtggcctgaaacccgggggcagcacggctccgtagctggagaggctgcccttgtagacacagaactcctcgcagtggccctggcgacagcgccgcagcagcagggcgtacaccagcggggcgccagcatcctccgcgtcatgccagcctgagggacggtccccacggcatcacgggagggctccgtgacgtcacagagtcgggggatcccgctgctccccccacgcaggcctgcactcacccgtgcattcgaagtgcaccttggtggtgagggcgtgcacagcgcccagtgggaagaggcggcaagagccccccagcggcgggcggttgggggacaggcggatggaggcgcagccctcctcctcgccagagcggcccagcaccgtgagcgtgaaggtgtatccctcgccgtcccgcagcacgccccgccgcagcaccagtcgcatgcctgcactgcccgtggatgtggtggtctcatccagcaccagcgtcttgttgctgaacgtacgtgcagcccaccgctgtaggtagaaggggtggtgagggggcgcaaccctctgccctgtcagccccacttctgcctgcaggccccgtcccctcgggcatgggacccatccccagtccgcccacaccccgttcaacactcacccctcgcttggagccgctgctgcaattgaggcagcggccctccaagtacacgtaggagctgcggctcacttcgtacacggcctgtgccttgcaggacacacactccaaggacacaatgggcacccggccactccggatcagcacctggcgtgggagtggggttacctccaacacaggtctatttggcctgctggaaggactgggggacccatggaggatgctgctcccaaactccaggtttcccaggggcctggccactgccggtgagctcactccctcccaggatactcatccggtttgccaccttccaacttggacggcggaagggcatacacagggcagaggacactggagtgtgcgttctggtgtactggacccagctggaccctagcaggaggcaggcaatgctcactgagggcccctggggggatgcgtgtgggaacagacgtatgtgtgggtgtgaggaccgcagctgccacgtaggcctgactcacagactcctgcagcccttagccagggcctgggtcaggaggctgagctgggatggaacctgctcccacaccctcccctcagacgacccctctgggaagacccccaatcaggccagctgaggaaagcagggactggggaacagacgcccactctggggcaccagcaggccccgcctgacagcagcaggagcagccaccacgggctcagggtcaccaagcctcctggccggtccagagaggggagcgtgagggtgagaaccggcccaccacatccagcaacagggacatgggctggggacagtggctacctctggggtgggaaggggctcttcctcactgttggtattgctaggggactgtgtagcttttgccactagagcatatgtggcttgaagactgtacgtggaactgtggcaggtttggaaggaagcaaagctgaagcaggctgtcgtgttacatagaatttgcatcagaaacagagaggggagagcgtgcggcctccaccagcactaaaacacggaaaacagtagatgaccagggaggctgggctgtccaaggcaagtggccgaggggcgggcggcacccaccgtctggttggtggcctcctccttgcggccggccttccacacggtcaggctgaaggtgtactccacgccagccgccagccgctcccgtggaatggtgaccgtgctgctcccgcggggcccaaagttcagcgcacacccgccagcctccctctgcaggccgagaacaaggggcgacgtggcctgagagccccatccagttttaaagcagagcccggcccaggagacagcgcgggagaccccctccccatgctgggacggggcccaccaggcactgaggacgggccagccctggtggcaagctgggtgttctctgggctcatgggtgtggacgggtgaggggcatggaggacggccctgccacgcactgacctgtgtcgaagccacacaggcccagtggaaactgagcggcgtctggtcgccgtcctccaggttggggtcgtaggactcgctcccatccagcaccaggtcccgtgtgtctgaccacacgcggtatgagccaccctcaatgatgggcaccaggcgctcgggggccaccgtcacattggcctggatgctctgtgtcagtggcgtgtccccaaatgacacgacaaacacaaagcagtagtgccccacaggcagcgccagccgcggcagcaccagccgaggccggctcacgtccacgccgggcagggccacacgcgctgggcgccccggccgctggcagctggcggtgcgatacacctcccagcggtactcagtctggtaggtgacgcagtcgcgcaggtcaacgtgggcctccaagtagttgcgctgtgatcgccgcatcagcacctgcaggggcaggaccacgtccacctccggctcccggcaggccagcacctggacggtcaccgtggcctgcgccacgaagaagctcaccaggttggaggcgttcacctgcacgcggtagtccccaggcctcaggtaggagtgctcggccctgggctcatctgtgtcctgccctggcgacccatccccaaagtcccagtggtaggccacacgccgggggctggggctggtggcggcctcaaactgcgccgagcggttggtgaagcaggggccgctctgcagggccacatactggacggcgtcctgaacctccagcaccagcgtgcggttctcactgcccagggcgttgaaggcgcgcacctggatctccaacagccccgcggccacgggcgtgtaggtgacgtcgcggcccgacaggatgaccagcgagtcgccctggaccttctgcagcgagaagtaccaggcgtaggcgacccgagagccgcgctgcacgcgggctgtgaagttcctctcagtgcccgtggcgatgccaggctcgcagcagttgggcatctgcagcccactcacggcctccagcaccacgatgcgcacctgcgcctgggcccagctcacgtggtttttgccccgcacgctcaccacgtggtctccgacgcgggggaagctgtgggagaaacggggcccggggagcacctcggggttggccccgccgacctgcaggcggaaggtgacagctgagccggcagccagcaggatctgaaaatggaccagctgcccgggcgccaccaccttgctgctggcccacagcaccaggcccacgatgggctcctccgccgtgaggttgtacgtggctgagacccagctgactgcgttggaggcattgagccggatggagaaggtgccagcatccgggaagaccatggtgacatgagggccacgcttgctgctgccgccgggcacagcccagcaccagctcacattggtgcccgtggccagctgcccccaaaagggcacagaggacccggccgccacgaagctgcctccgggctcgctggccctgatgctgaggccactcacaggcacctgcacatccacttccacggtggcgttggctgagcccagcgggttccctgccgtcatggtgaccaagtgcaggccgggtgtggggaagctatgggtggtaaatggctcggaggtctcccagctcagcccctcctccaaggaccaagtgtatacgacaccactgccaccagccagctcggcactgagggtgacgcttgtgttgacggcagctgggttcggggaggcggtcaccatcagccaccccacaggctccacgaagtccatggtgcagtcggcccaggcgctgcccagcatgttggtggcccgcagctgcacatggtaggtgccggcctcgagcacggtgagcgagaagcctttgccgctgccggccagggccgggcccctgtccctccaggcagtccagctgtaggagacgttggtgccatccctaaccacggcctgcagctgtaccgtgtggttggtggggaagtagcggccaccgcccaccacctgcagcccctctatgagctgcaggacatagacgaagatgctgtcctgggcggagcccacctcgttctcagccgtgacgatgatattgaaggtgcccacggagcggaaggtgtaagagatggtaggacccccagggatgggcgtgcagcggtcacagagcacccaggaatagcgcacatcactgccggcctccagcgacgtgctgaagctcacgctcccattcaggggcaccaccgtgcggcttgcattgacgacgagcccccgcacgcgccgcttcaccgtcacattgagccaggcctcgctgcggctcacctcattccagccggccaccctaacggtgaagtcacctgtgctgttgtaagcgtgggtgacctccggaccctcgagccacccaccgtcccccagatcccacaggtagctggcggggcgcccacggcccacagcagagaacaggtacggctgctgcagctccagcccaagggagccattgaccttgatgctggtgaccagcacgggctcctgcacctccaccagggctgagtcattggcagcagagatgttgttggacgcggtgactgtcacaagataggagcctgggtctcggtagatgaacgtcacctcagggcccctggcacgggtgggggcggcttcctcggtgccaaagtcccaggtgtagcggtaggggaacgggggccaggcacatgccaccagccaggcctcgtccccgagctgcacaaactgcctctctggctgcagggtgacgttgcccacctctggctccacgcagatgctggtgaagtaatgcgccctgttcacgcggctggacagcaccagcgccagggggaacgtgccgctccgcgtgaagttgtgtgtcaccgtcgggcacccccgcacggtcgtgttggaggagccatccccgaaggtccagtcgaagaggtagtgggccgggttcccggtgacgtaggccgtgagccgcgcgtcaggctgcgtggggatgcaggcggcgggttcaacgcgcagcacctccaggacgaagaccagcacgtgcaggctccgggccaggtggccggcggggctggccgcacccacggtcactgtgcagttctgtgcccgcaggtacacatgctccactgttgcctccgggcccgacagcacggtgccgtcccccatgtcgaaggtccacgtgatgttgtcgcccgtctgcaccgcggcgctgaccaccacgggggcgccctgctccacggccaggctcatgtccacgctgagtccgcggagctcctcaaagacgcgcacatccgcctgggccgccgcaccgctcaccgtgttgttgacctccaggcgcacgtggtaggtgcccctcgaggcataggtgtggttggcagccggctggctctgggtcaggacaggggagccgtccccgaagtcccacgtgtaaagaacacccccaggcgagggcagcgggtgcgggtagaaggtgacgggccggccggccaccaggacgccgtcactcacacccacagccacggagggcagggaggcgcgcacgctcacaggcacctgctgcgtcaggttctcgaaggcattagatgccagcacggtcaggaggtactcacctgtggggacaggcccgagtggggcagccgcggcacccccacctgctccccacccgctcggcagaagccccccgcctgaggagcccggggtgaacggctgcacctgcggcccagccttaagggtcccaggctcccaagccacgtgcgggacggagcacaggtgtagcagcactgagggctgcctggcgaggacggcaccgcctccaagtgcagctgcactcggggcagcagagcagcaagagccaggcccggggagggcggggggcgcagttcaggggcccagcttccctgtccactccccccacgcctggcccctccctcaccccagtaggggcctaagccatcagcccaggtgaggtcacagtgagggctgttggggaggaaggggggcagcttgactggggagctggggggaccccgtgctcagagcctgaaaggcagtggccccctcaccccctcatccctcacctggggcagcgtaggtgtgcatgacattgtgctccaccagcacctgggccaccgaggggtctggaaccgggaaggactcgttgtacggaggctggaactggtggagggcctgctccccatccccaaagttccacctgccggggcggtgggacgcagtgagtgaaccgggacaggggtgggcggtggcggggcagggggtgcttgggacccagccgaggctccactctgcagtcacgccccgggcctccattcagggcccacccggctgtgctgaggcctctcccggctcccgtgcagcctcagggctcctgtgcacccagttacctcccaacagacagggaaaccgaggctcagaaaagcaaccccgtgatgtgggggtccctcggctgaggctggggctgggacaagagcctggtgcccaccccaaaccggcccccgagtcactcacaggaaggccacctccacggccgagtccaccagcacgcccgccgtcagtgctagcgtggcattgggggacagcacggccggcactgtggagacctgcagaccctgcatcctgttcatccgctccacggttacgttgtagttcacggtgacgttgctcacgtggttggaggccgtcagctgcagggacaggcatcagtgagcccaggtggcaggtgagaggcctggccctgattggcgtccctccctccactcacccacagccatggcagcgtcctcgggcagcatgaagcagagcagaaggcagaggtgaaggtggagccgcccccgccctgccccgccccatcccctcccctccccacccccgcccacctactgagagcttgaagaccgccgcgctctgataaatgacattgaagaccacgttctggaaggtcagggactgcttgtcgttgatggtccaccggaagaccatgtccgagccggcctccaccacggggctgtacctctgcggggggaatggtgtcagcctgggctctgtggaggactctgcccttagcctgtcgcctcctggacacacctcccgtcgggctggagagtcccacgcggggcacagaggagaggaggtgcccggggctctgcatgccatgggagccaagcccgggctgggacactcactgtccggctctccagccagccatgtagtactactaatgcctcaacctctctgtgcctcagtttccccatctgtaaagcaaacctagtaccagctacaaagagtccacctctctctgagtcttctcagaccctcccggcgctcttgccccagctcctcacccagagagctcggagcagtgaggggaggcacacgggcctcacagggacagcacctacactggcttacagaacccaggacaggctgcacaggtcacgccatttctgatggcccctcccaaggcccctggtgaagaggcaggtacccgcaagatggagacagccctgtcccccatgtacccagcatggtggcaccgcgggcagcccgcagtttcccatcaggggttcagactccacctcaaaagccactcgctttagccaggcgagaacacagcagagggcgtgagagactcacgggggctcgtgtgaggtcagggagcagagttttaaattcattttgtgaaatgagacagtggaatgagttagcggagccactgtcagagccgtgactttccaggaatttaaagcccaccaggtagcccgaggagccagccagcaggacctgcccggggccgacgtccccagtaactgggctgctgccctcactgggaagccaggcctcacgccctgtgtgagcaccctgtctgcaggcacctgcctgggggctggtggtggagcctcggccatactcaccactaggactccctgcagtacacgggcctcggggctgggcgtggcgcggaggccacagatgggctcctccgccgtcacccgcaggctgaggttggcccggctggcgctgttttccaccaccacgtccaccacgtgctccccctcactgagccacggcagtgctaccactgagaacagggtatcgttggtctcccaggggcagccgggcacgaaggtggccaccagggcagggcagacattctcaaagcgggcgctgacactgcccccaggccagcgagccgtggccgtggcgttggcaccagagtccacctggagcaccaaggctgagccgttggtgggcacgtagaggcggccgtcgcggggggcagggtagatgacccgcagcccagccactggggagaccacgtcaaagctgcaggagaggttgtgcctggacacgccattgcccacctctgcccggacctcatagcgcccaggcatccgcagtccagggttgggcctcaagcccagcagcacggtgagctgttccgtggctgcaagcagccgcagggcacaggcagggcaggcccaagtgccctccagctgggctggcaagtggggcagccatgacgaggcgttggcggagaggtacggggcctggggaccagggtggccgggagccggcgagcagtgcaggagggcgccagggccagcgtcgtgctgcaagccaacgaggtcaccagggagcatgaggacatcctggccgtggagggtgacctgtggagagggagccagggctgcatcacgtcctcacggtcatggcccgtggacccccgcacgacggatgagggtggacacgcagggctccccgcttcgtcagccacacctcaaggagcctccccacagtgctcgtgacaaggacaggcaggacagttgcagaccgggggacacacggggagaggacacaggccaagacctggcagacaggaaggagcagctgtgctgggagagaggaagaggaggcacagctcgtgccaagggcccaggcgagagcttctcccactgggagaggcccgagggcactgcagaggtcggaggtcagaggtggcaaggacgtgggaggggcctgcaggctgggtgtgtctggtgcacagacccagaccctgggcagcagacaggaaggtggcctgaggagatgcagggaacagacccaggtcagggccacacaccgagtactgcgcggggggccccgcggcaacggagaagaggaactctctccatagcgcatagggggccccgggtagccctggccctgacgtgcagccattggcgcaggcctgggggtggcaagaggcgtccagcggcaagcagatgttggctccagggcaccagcgtccccctggcatgcacgcgggggccagctgggtcctgttgtccggggacctgctctcaggctcgctgccgttctccggggtccctgtgaggaggggagggtgttggggccctgatttgcccacaggccaccgtcagagatgcccaactgtctgcaccagcaatcctggtcttgctgtgaggacaggtctccccacctgggcagcactcccagcccagtgctgcgtccgtctccggccaggcgactgacccaggccggcccccaggcaggccccacccaatccacccccaggacacctggaatgagctggtgtctctggaacccctgctctgtccacctaagactgggaaccactctggtggccacaggaccagcagacgtgaaagctcagagaggccaccccgagtcctgcggcgcccaccacccaccacccaccacccagagtcccacctgctgtgctgaggagccggtacacctgcagccgcagctgggcgggccgccggagctcctgggtcccaaattcggccgtggtgaggaaggcttcacggctcagacgcaggcccgggaataccatgacctggtgggcagggggccgcctcagctccacagaccccatcccagcctgaagcccagactccccctacccgaacttcccaggaagaggggagggaaggagagcgagccatcagacccccacaggcctggctcctgtcgctcgagaggaagactccggtggaaactgtccatggggggcaggacccctgacctgcctttcaggaataactcacacacgctcagagaaaaggcctggaggtaatgtgagtaaacgctttcctctctgcactctggattttcccaaccatcttcactgggcacaagcaacattaaggcccccaagttttttggcgagacccacagtgggcagggcaggcaaggcctccaggggcaggcaggagggcaggttgtagaacgtggggggccgactacctccacgggctcgtgcggggctgagaggccgtcctgctgtgccagaggcgtcaggggtccctgcaggtccccactgggcgctcccacgaggaggttctcggcatcctgcactgggcctggggtggcgagtgcacagtgaggcgccgggccagggcccaggacaccaggacgaacagactggggaccgagccgcccgaaaacccccccaccagcccctcctcctcagcccaggctccaccgcgggcgctcggcaggcccctaaccacagccagcgtctcaggcccctgcctggccccccgcacacctccgggctgcagctcgcagacgtagctgtgcggcgctgagcacaggtcggtgttacaccacccggtgggcccgagccggacgcagtgctcggctgtggctgggtgtggctccccgggcagccagttctggcagctctccaggctgaaggcctcgccctgcggcgctgggcccacctccaccccctgcacagtcgagaagccgatccacacgtctaggctcctgggggcgggtgtgggatggcagggggctcagggcactcctccatcctcccaccctcacaggagcccgctgggagccccatcactgtccccctttccagatggggaaactgaggctcagagcccggagaccagggcccaccagcccaggctcacagcagcacccacccacggggcctgtgggtaccggcagggatccccgtgcaggccacctcccgtatggcgtgcccaggagtgtccggaggctgcccccagctcatgtccacctctgcatctgcagagctgacaggaacggccccaccggccggcgccacctgctcaccagggccggcccagctcccacctccttcctcctgagactccccacccccaggctctgccccagtgcttcagagatctcccaacctatggcccctcggggggtgggggcaggcacctggtgacccgggagaccaggaagcgctgcacggcgggactgtccaccattgccagggcggccccggcccaggcctgacactgctcctgcgcctgcagccaggccgccttctccaccaccaggcggtagcagtgcccgttgccagggaagatctccgtgtccgaggggcagagcgggtgcaccgctggagaccggtgggaacgagggtgtcaacggtcagtgtgggcccaagacgggggtaccaggctctgccccatctggatggccctggggaggaaggggagtgggcagaagacactcacctcgggccggctcctcgcccagggccacgatgctgtaggcggcctccaggcctgaaccaccgcggttctggatgctgaggtcaaggctctcgtcactctgcaccgaggacgggcacacgagctccagggcggcaggtgccgcttccacctgcacgtctgtccccagcagggctgagccggcccccagggccagcacggccgtcacgtgatagcgcccaggcagcacatagcgatgcgaggcagccggcccagcggcatccacctcggcggagccgtctccgaagtcccagcgtgtggcagtgacagggagcggggcagcgatgtggaaggctgctagctggccagaggccagaggtccgtggggccccaccagggtggcccctggggaggcagggaagacgtgctggaggagggtggggcccctacaggtgggggcaggaggtggcggggggccggagcagagggacaggcaggcaaaggaggcactggagggctgggccgccccacacaggcaccagccctgctccgagagggctgcgaggccctggccggtggagaagcagaaggcgctgcaggcctctggctgaagcaggccttcgtgggcagctgaaaaggacactgctgccacggtgcctgagctgttgtcagggaggcaggcgacatactcctcacctagaagaggcagccactggaccccgggttctgctcctcctggctccaccccacgcccccacatccgcccgccgcactcacaggctcccatgctgttcccttggcccggaggccccccccagagaggccttcctgagccctgcccagtgtctgcagggcccaggtcccacctggctgggaaggacagagctggccccacccaccggcactcaccacagccactgtccagcaaggggatgccaagcagaggctggccagccagggagccaggcccagcacacgtggctgcctcgggctgcaccacccgcacctgctgctcctccgcccatcgcggcagccacgccaggccacagtcacactcaaacgggttcccactcaggtttctgcagggcaggggcaggtgttggggaccaggtctggtgggaagggtctatgccagccccccactggcaaccaggccctggagccaccctgacagcaccgcctcccctgccccaaccaagccggcactggggggctccaagcaggcagtgaactgcccccaggatctggtctcaagcctggaaggggacacggaccaactgggagggcagaagggatattgggggcctggggtccagccaggaccccacccaaagaaccacaacttacatttcacttaaattaaataaattagcaaatattccttcttctaacgtagaaatcttgttgttgcttatatccctggaagagacgggggattcggcaaagctgatggaagcccccacagctgagcagcaagaggcggtgccgccagcccacccggagtgagccccgcatgctggcacgactgggggacactcacagctctgccagcgccgagaggttcgccaggagcccaacgtccagcgcccggagcaggttgtgggagacgtctctgaggagtgagtggccgtgggtcagggccagagcccctagtaggccagaggccatccctgggcccatcccacacattgccagcatccccaagctatggcctcccacccttgagctccccactcccagaggtcaggaggggactttctgatggaagacccaaatgaacactcatctggggaaaccaagccaggagaggcctgggggcctcagccctctgcacccatctcagccctatgccgagtgccacatggacctgtccacccagggccaggaagggcacggacccccaacccatcccacgcagggccaaggccccccatcccctgtccacagtcccccacagagccaaggtctcccaaccctgtccacagcccccacacagactcgaggggcccccatctcctgttctgaacccaacagggtggtcccactgtgggaccacaaccaggtatgactgtgtgagaagcaggctcactaccaggctaccagggagcacaggggagcaggcgccacctcgaggcataaacccagagaaacaagacctccaagacggccaggcactggggcacacgccggtaacacagcaccgtgggagctgagacggaaggatcgcctgggcccaggattttgaaaccaccctgggcaacacagtgagaccccgtatctacaaaaaatacacattagccaggcatggcggcatgcgcctggggtcccaagtactcgggaggtagaggagagaaaaatcacttgagcccagagaggtcaaggctacagggagctgagatcgcatcactgtactccagcctgggtgaaacggngagactctacctcaaaaataaataaatacatacataattaataaataaaacatcaaagaccagccgacctaactccatctaaaatacacaacttctacgcaaaatataaataaaattagaaaacaanctacaatctcagaaaagcactagcaacttacacgacatactaaaggccaaaaataccctcctgacacacagctaataaagaaaacgtcaactattccagttaaaaagaagaaaaggaaactgggtgtggtggcttatgcctgtaaacccagtgctttgggaaggccaggagtttgagaccaggatggacagcatagcaagaccccatctctacaaggaaaaaaagaatcagccaggcatggtagtgtgtaactgtagttccagctactcggggggctgaggaggaaggatcgcttgagccagggaggtagaggcctgcagtgagctatgattgtgccactgcagtccagcctgggcgacagagcaagacccggtctcgaaagaaaacaaagagaaagcaaggaaagaaagatggccgggcacggtggctcactcctgtaatgccagaactttgggaggccaaggtgggtggatcatgagatcaagagatcgagaccatcctggccaacagggtgaaaccctgtctctactaaaaatgcaaaaattagccgggcatggcggcgggagcctgtagtgccagccactcaggaggctgaggcaggagaatcacgtgaacccgggaggcgaaggttgcagtgagccaagatcacgccattgcactccagcctaggtgacagagtgagactctgtcaaaacaaacaaacaaacaaacaaacaatcaaaaaagggagaaatctgctgacataccttctttatgctgtctatatataggaaagtgggcatgtattactttcataataaaagtttctttttagagacaaaaacgatataagaagtccatggataaaatcggcatttattcagaaggcatgatgccagagaagaaactccccaagtgggagacaatggctggcccccctgcaaggtaaacaaggcttcagcccttccctactccccagacctgccgggaaggctgggagcacagttcaatggagggtctctggggtgggcctgggtgtctgacctgtccctcttgcccacaggtgaatgtgacctgcgtcctgaggatcccgagtatcaggagagctggcagagggaagtcatgcagaggcaaaagcaggaagccccgacaggatgaatcctccaagtgtgtcagagatggcagggtggccgccatttgcaaacttcccggtgctcatcactggtctgggagggcagagagcaggggtgaggcttcagtcccagacatccctgccctgggtgtccctggacaggccacccccagcccttgcccggccaatgctgacctccagggcgatgttgtggaaggtgttcacgtaggctgcgcctcccaggagcccctcatacagaatgatcaggaagacgaggtagatgcttggcagaaagccgaaccacacgtctgccagcaggaacaccaggttgaggcactgtgaacagggggagaggctaagcctgggaccagggcggggcagggaaggagaggtggcctcccctccaggggtccctggttttaggagttactggtgaaggagagggctgccaggtctagataaaatctcaacaccagcccggtgcggtggctcacacctgtaatcccagcactttgggaggctgaggtgggcagatcacctgaggtcaggatttcgagaccagcctggcctggtctctactaaacatggtaaaaccccatctcaactaaaaatacaaaaattatctgggtgtagtggttctgtagtcccagctacttggaaggctgaggcaggagaatcacttgaacctgggaggcagaggctgcagtgagccaagatcgcagcactgcactccagcctgggcaacagagagagactccatcccaaaaaaaaaaaaaaaaaattctcaacctcagcctggtgcagtggctcatgcaggtaataccagcacattgggagaccaaggtgggatgatcacttgaggccaggagttcgagaccagcctgggtcnacataacaaaactccgtctctacaaaaaatttaaaaattagttgagcatggtggcacgcacctgcagtcccagctactcgggagtctgagacaggaggattgcttgancctaggaggtggaggctgcagtaagctatgattgtgccactgcactccagcctgggtgacagagcaagatcctgtctcataaaaaaaaaaaaaaaaaaattgggggttccttaagggaagtgggaccatcgaaaccaggatttctcaattgnagcactcttggcgtttggtgctggttgttctgnatggtgagggctgtcctgtatatggcagcgcatttagnaggatccctggcctctgcccgctagatgcccatagcatccctcagttgtgacaaccaaagcatgcctgcagacgttgccaaacatccgctgggcagcaaaattgcccctattggaaaaaccgttggttcactatggtaaaacaaggtgggagtagccgggcatcctattcagctgggctcgaactcctggtctcaagcagtcgctgcccccctgcctcagcctcccaaagtgctgggattataggcaggagccaccgcacctggccaggaagcctcttcgatccccaccccagggtgtaggtcccacctctgtgccccagtctctcaaggaggtgccatcctcccagcactgaccacgccacattgcctcttgtgcagtgtgtaggcctcctcgtggcggttcatacttttcgtatatgtaagaatcgcctggggatctaggtacaaatgccccaagcggggcttaccctagaggtcctaattcattaaatctgaggtagacttaaagatgagcattaaaaaggacacacctctagccaggtgtggtggctcacacctgtaatcccagcactttggaaggccaaggcgggtggatcacctgaggtcaggagttcaagaccagcctggccaacatggcgaaaccccatctctactaaaaaatacaaaaattagccaggtgtggtggcacgtgcctgtaatcccagctacgcaggaggctgaggcagaagaatcgcctgaacctgggaggcggaggttgcagtgagccaagatcacgccattgtactctagcctgagctacaagagcaaaactctgtctctaaaaaacaaaacaaaacaaaacaaaacaaaaaatttgctgggcgtggtggcgcacctgtaatcccagctactcggaaggctgaggcttgagaatcgcttgaatctgggaggcaggggttgcagtgagccaagattgcaccgctacattccagcctgggcaacagagcgagactccatctcaaaaaacaaaacaaaacaaaaaacattatagctaaaaacatgtagcttaaaaccataagctacatgtttcagtggtatctacaagcaccctgagttataaatttggggttttgtgggtacaaaccctgggcttgcagcactgctcagataaataaggaaggaggctggaggatatttacatgctttttccataatatgaaagtgtaatcttttttttggagatagggtctcacccaggctggggtacagtggaatgattatggctcactgcagcctggaactcctgggctaaagcgatcctcctgcctcagcctcccgagtagctgggattacaggtgaatgtcaccacaccctgttgttgttttttgtagagatgaggtctcgtgatgttacccaggctgctctctcaaacttctgggctcaagcaattctcccacctggcttatttttttttttaaatttttggtaaaggtggggggtctcactatnttgtccagtctggtctcaagctcctggcttcaattgatcctcccaccctancctccaaaagcattgggattacaggtgtgagccacaacacctancctaaagtataatctctatttctgtatttggctatcacanaattgagttcctaagtctttttttttggagatggagtctcgctctgtggcccaggctggagtacagtactgcaatctcggctcactgcaacctccatatccggagttcaagcaattctcctgcctcagcctagcgagtagctgagatgacaggcaggtgccaccacgcccaactaatttttgcatttttaatagagacggggtttcactgtgttggccagactggtctcaaactcctgatcctgacctcaggtgattcacctgccttggcctcccaaagtgctgggattacaggtgtgagccaccaggactggccaagttcctaaatttcaaaggcagaagactttcctgtcacagttgacagtttattgtaacagttacctgcaggggctgtggatttgtaaccttgaaacaatgaatgctggttatatgaaactccttttattagactgttgtaaggaagggtgtttgcncccttaaagctgtaaactactgtttgccaagggcagttgaatttgctcaccaccctcaagataaataacccactgacttcaaannnaccaattctattataattaactatctagaataaaagaactgtacattnncttaatagttagaaacattatttgaagnngtctctttgcctgagtaaatgacctatgatcatgccactgtactccagcctaggcgacagaggaaggttccgacttttcctttcttttttctttttctgggagacagggtctcgctctattncctaggctggagtgcagtggcatgaccttggttactgaagccttgacctcatgggttcaagtgatcctcccacctcagcttcccagtagctaagactacaggtgtgcgccactgcacctggctaatttttgtagagatgtgattgtgccatgttgcccaggctggacttgaactaccaagctcaaatgatccacctgcctcagcctcccatagtgctgggattacaggcatgagccacctgggccggcccaatcccaatgcttaaaacacacacacacacacacacacacacacacacacacacacacacacacacgcacacacacacacacactacaaaatcttgttcttcgattctttctctcatctctatttcttacaactaccctgaaaaataggtattggccacacccaatttatacatgaggaaattgaggctcagagaggttctgagacctgccctaagtcacacagtggctgagtactgaagctcagttttgcttggctcctgaggctatacattttacatggagctctgctggactttggttccctgtgctaagaaatgatagtgtacaatttacacttccctgtaatcccagcactttgggaggctgaggccggcagatcacctgaggtcaagagttcaagaccagccaatatggcaaaatcccatctctactaaaaatacaaaaattagccaggtatggtggcgggcgcctgtaatcccagctactcaggagagctgaggcaggagagtcacttgaacccgggaggcagaggttgcagtaagccaagattgcgctactgcactccagcctggacgacagagcgagactctgtctccaaaaaaaaaaaaaaaatttacacttcccactgatagtgggaagcagggggtttggggaagctgggagccaagctgggagccaaggtgggagtgaagtgaggggcaggggtttggtacctgcagcagggccagggcccaggtgaaacggatgcgacagcagcggagagaagagcgggaggcaaagacgccagcctggtacagcatctggtacctgaggttagggttggggggaggagaggaggctcctccagggaccatcccgctccccccggtgcctactgggcagggcagctgcatcaccacggcgccctcccagcccactgccctcgctcctcttaccagcggtattgctgagcgtgactcagggaagtgttccagaaaaagaggagttcaaactgcaacaaataccagacaggggagatggacggggctgtgtgggtcccagccccaatcgccacctccacacccctcctagcacccctcacttacaagtccctggttaatgaaatactcggcaaagtaaactacgaccaagggaacaatgtaccacagcagaccctggaaaaggcagaagatataagcggggggcctggaggtgagcaagccccacagggacataccccagccatcatccgaaccttgaanactgtccacctttcccgaagggagaggctggagctggagcctgcaggggaacagagagagaagggcagatgaagttttcacactgaagactcggcaaagaggcaccggtatgacagaattaaccagaccacgcaacagtgggaactcacttccatgccactggattggacacttaaaaatggttaaaatggctgggcgcagtggctcatgcttgtaatcccagcaccttgggagactgaggtgggcggatcacctgaggtcaggagttcaagaccaccctggccaacatggagaaaccccatctctactaaaaatacaaaaaatcagctgggcatcgtggcaggcacctgtaatcccagctactcgggtggctgaggcaggagaatcacttgaacccgggaggcagaggttgtagtgagctgagattgcgccattgcactccaagcctgggcaacaaagagcgaaactcccgctcaaaaaaataaagtaagataaaaaataataaaatggtaaacttcaagtaatatacatactttatcatgatgaaaataaaagctaaccaggtgagacctcttcacgtctctttgatttttaattttttttattttttgagacagagtctcactcagttgcccaggctgcagtgcagtggtccaatctcagctcactgcagcctctgcctcctgggttcaagtgattctcgtgcctcagcttcccaagtagctgggactacaggcatgcaccaccacacctggctaatttttttatttttagtagagacggggtttttaccatgttggccagactggtctcaaactcttgatctcaaatgatccatctgcctcagcctcccaaagtgctgggattacaggtgtgaaccaccacgcccggccaatgtctcttgtacagctccacagatgggcattggcccaccctgcccagtctcactggccattctctggttctagaacatcccagcttatccccaccgcagggcctcagcacttgtgattggaatgcctggcacatggtaagtactcaattaatatcccttcttctctccctcccttccttcctttcttttcttttttttttttttgcgacaaggtcttgctctgttgcccaggctggactcagacttctgagctcaagtggtcctcctgcctcagcctcccaaagtgctgggatattacaggcgtgagccactgtgctcgtcctcaacaagtatttctcaaatagacaaaggcttttcccataaccagtacactcactctctttcccctcttaactttgcctattgcagagaggaaaaggccaaacccagagagaaagaaagtgacctctctgagggtctgtgtctcctacctggcttcgactccggggcctcggttcttatgaggggctgccgggctgcgctctctgcttcttcttcccctccagggtcctgggcctcaggagatgtgagcaacaagaaatagctaggagtaggatgaaggcagggtcagaaaaccctactggctgggaaggtccccagggaccatctaggccacttttcccagggaacacctctacctttgaacactttcaaagatgggtagctcactgcctctaaggctcctacgctgtgcgggagagctccaattgtggacaaaggcttctttctttggacctgaatttatctccttattcctattcatgggccttcattttgttttgatttttttcagagacagggtctttctccagcatccaggctggaatgcagtggtgcaatcatagctcactgcagctgcgacctcccaggctcaagcaatcctcccgcctcagcctcccaagtagcggggactacaggcacgtgccaccaagcccgcctcatattttccattttttgtataaatggagtctcgctatgttgcccaggctggtctcaaatttctagcctctagtggtcctccagcctcagcctcctaaagcactgggattacagctgtgagccactgtgctcagcaggcccttgttcggactgctgggtcatacctagcgagtcagtctgtttttctggcaccatatatctaatggcggtctagctccccataattatacgttcactctgtgctaggccagaacttcctcgattttagtcacttaggttctggcttcatgttatttgccatatccatattcctcctgtatatatatatttttacttaatatttttctttaaatggactcactttttctacttagacttgtcctaagcactaatcttgtgaagggccaggtgtgtctggctagttcaaagtgtgtgttttttttttttttcaaacggagtctcgctcctgttggcccagcctggaattgcagtggacaaatccaggggttcactgccaacccccggccccccgggggttcaaacaaaaccttccccccaaaccctcccaatttacctgggggaataattttgaattttagtagagacggggtttccccatattggccaggctggtctcaaactcctgacctcgtggtgcgcccgcctcggcctccccaaagtgctgggattacagatgtgagccaccatgcccggccaaagtgttttgtaatatgcatgaaaatacacagaactaatcaggccgggcgcggtggctcacgcctgtattcctagcattatgggaggccaaggcaggtggatcacttgaggtcaggagtttgagaccagcctggccaatacagcgaaaccccgtctctactaaaaatataaaaaattagccaggcatggtggcatgggcctgtagtcccagctactcgggaggctgaggcaggagaatcactagagcccgggaggccgaggctgcagtgagctgagatcacaccagtcactgcactccagcctgagtgacaccatgagactccgtctcaaaaaaaaaaaaaaaaaaaaaaaaaaaaggggagtcgccatggttcaggcctgttgccctggcactcaggcaggcaaggttacacattcgaggccaacctggtcaacactgattaaaaaaaaaaaaaaaaaaaaaaggaactaatcaantaangtccaccctcatccaacttctaatcaccttgggaaccacactgtgctgaatgcattaccctcatcacctccaaggaaagcaagaacaactgccatttgagatatggggaaactgagggttcagagaggtggagtaacttgttcaacgctacaaagctaaaaagtggcagctccaggactcacacctggggctatcagagtccagattccgcctcccttcacagcaaggtagggacttgaagattgcaatcataatcaagttttcttttctttctttttttttttttcttcctgagacagagtctaactctgtcgcccgggctggagtgcaatggcacgatctcggctcactgccaccactgcctccggggttcaagcgattctcctgccttagcctcctgagtagttgggactacaggcacccgccaccacacctggctaattgttgtatttttagtagagacggggtttcaccatgttggccaggctggtttcctgaccttaggcgatctgccctccttggcctcccaaagtgctgggattacaggcgtgagccaccacacccagccatggccaagttttctctccttggacccctctccctcccggctcagggcagctcacctggccagcagcagggcagggatacccagcatggacagcagggtctgctgaggggagaggccggcctgggtgaggcccaggtaggacagggcccccagcagcccagctcccccagtccctgaggaccaccaggagatcacggccctgggaaggagaacacaggaacattcaggaggacctaggctgaccatgggacagcctctccccacactccctgctccacctgcttacctggggtagaaggcagtgagggagaggaaggtgacctccccaaggcctgatgagatgctagcgaagaccacacctggggggaggacaagcactgggatggtcacaccacaccttgccacactgcccaggcctctaatgtgtctggccatggcctcctcagtatcagctcatagaggctccaatagatcccatgcataggccaggttccaggtctgaagcagagccccactcccctgcgtgtcccttcatggagagtggcacctccatccacccagttatcagaccaggggcagacatgcacccttgatgtctctgccccttcatcagtctttttcttttcttttctttttggagacggagtctcgccctgtcacccaggctggagtacagtggcgtgatctcggctcactgcaacctctgcctcccaggttcaagagattctcctgcctcagcctcccgagtagctgggattacaggctcctgccaccacacccagctnatttttgtatttttggtagagacggggtttctccatgttggccaggctggtttcgaactcctgacntcaggtgatctgnctgccatggctttccaaagtgctgggattataggcatgagtcactgtggctggtccatcacagagtcgtgactgtgttcacctcaatctccatctaagtcatccattttctcccatctcctccactgcctacccctccaaattgtcccagtctcccatcgcctactgctgatagccctagcaggcttctaagggtgacagaatgaatccctttcctctgggaggctggggagactcttcccacaaatgctctgatgtggttcctcggggctccccatctgacacagaaccacacactcaccacacaggctggtccccacagaatgagaaaaggcaaccaggacgaagcttccagcagcacaaatcccactgacgagaacccgggggctgagggggtgagaagggaagggagggggaaggtcggtctctactctcagcatctcagccatcccagcctcccctttctcagctcctgcccaccctgcctcccactaccctcacccagacctgtagggcagcaggtgaaggccaagaggagccaacaatttgatgacgagtgtggggaggatgtccgccaggagcacagcctgggacaggagaatagagtgagaccgcagagcttccaggggacaaccctcccaaccacgtggccaaggagaggcaggagctggccaaacaggcctgctacaaacacaggctctggagtcaggcacgcctgggttcaagtctcagctctcccactccttagttgtgtgtcaagagtttatactctctgagcttcagtttcctcatctggaaaatgggaatatcatagcgcctagctcacaggactgctgtgtggcttaaatgagctaatatatggtgcagacagaaaggactcagaaactatatatatatatattttgagagtgagtctcattctgccacccaggctggagtgtagtggctcgatcttggctcactacaacctccacctcctgggttcaagtgattctcctgcctcagcctcctgagtagctgggattacaggcgtgcaccaccatgcctggctaatttttggtatttttagtacagatggggtttcaccatgttggccaggctggtcttgaactcctggtctcaagtgatccatccgcctcagcctcagaaattatattaaggtctcaattattatatatatatattttttttaaaatttttttccttaagatgggggtctcactatactgcccaggctggtctcaaactcctaggctcaagtgatcctcccaccttggtctcccaaagtgctgggattacaagtgtgagccagtgcgcccagcccaggtctcaactgttttaatcatgacagtcccagctgggtagtgaagggctgggagtggggtctatagacccaggggccctgggtcaggcaaggaccaggtgagatgagtacgcacagccgtagagacagagttgcagtcaaatcgtgatgagctgttgtgggggatcggcgttgggcctgggtccacctaatgggagaaaagcatgtctttcaccctggaggcagagggatagacacacagagcctggctcccgtcccagctctgccttcacttgaaggatggctttgggtcagcagtgactgacttctcaggacctcagcgtctctgcatgcacaatgaagagggggtttccatatgagtctcacactactagaccacaggccacagatggccctgtaaatggactttgtttagataacacattcaagagctttcttttttttgagatggtgtctcactctgttgcccaagctagagtgcagtggtgtgatcttggctcattgcaacttccacctcctggcttcaagcaattctcctgcctcagcctcctgaatagctcagactacaggtgtgtgccaccacacccaggtagtttttggtatttttagtagagtcggagtttcaccatgttggccaggctggtctcgaactcctgacttcaagtgatccgcccgcctcagcctcccaaactgctgggattacaggtgtgagccactgtgcccagccagagactggaaactttaccccaccttgtcccaccccctcatcttcccacagggactaaccatggtggtggtggtagagagtcacttacatggctctggtttcccgatgtcctcttgtggctaaggatgtcgtgggcggcactcagcatcaccacataagagaagttgttgcaaaggcccagcagcctggaaggagcaggacaggtctcaactccctcctcatcctgcagccatctgtagcctttgtgccaaaccttcccttacctgtgcccttcaatcagccccctcttttttttccctctatcaccagatcccatcctcattcaatgttggggtcaaaaatacaggctttggtgcttgggcaagatagtgagacccccatctctacaaaaaatttaaaaattagccaggtgtggtggcttgcactgtagtcccagctacttgggaggctgaggtgggaggattgcttgagtccaggagtcagaggctgcagtgaactgtgatcatgccactgcactctagcctgggtgacagagcaagaccctgtcacaaaaataaaaaataaaaaggaagaggccgagtgcagtggctcacacctgtaattccagcactttgaggggccgaggcgggcggatcgcctgaggtcaggagttcgagaccagcctgagcaatatggagaaaccccgtctctactaaaaaatacaaaattagctgggcgaagttgcacatgcctgtaatcctagctactcaggaggctgaggcaggagaaccacttgaacccgaaaggcggaggttgcagtaagccgagattgtgccattgcactccagcctgggctacaagagcgagactctatctcaaaaaaaaaaaaaaaggagagtggtcacagagagtttctgggagaggccttggaggctggaagtgaatccaagtctgtgatcccaaagcccctatgtcagggcggggcacggtgctcacgcctgtaatcccagcactttgggaagtggaggcaagcggatcacctaaggtcaggagttctagaccagcctgaccaacatggtgaaatcctgtctttactaaaaatacaaaaaattagctgtgtctggtggcacgcacctgtaatcccagctactcggggagctgagacaggagaatancttgaaccttggaggtggaggtttcagtgagccgagattgtgccactgctctccagcctgggtgatagagtgagactctgtctcaaaaataaaataaaatttaaaaaaaaaaaaaaaaagctgggcgcggtggctcacacctgtaatcccagcactttgggaggccgaggcgggcggatcacgaggtcaggagatcgagaccatcctggataacgcggtgaaaccccatctctactaaaaatacaaaaaaatagccgggcgtggtggcaggcgcctgtagtctcagctactccggaggctgaggcaaaagaatggtgtgaacctgggaggcggagtttgcagtgagccgagattgcgccactgcactccagcctggaggacagagagagactccgtctccaaaaaaaaaaaaaaaaaaaaggttcaggcccggcatggtggctcatgcttgtaatctcagcactttggaaggttgaggtaggaggatcacttgaggccacgagtttgagaccagcccaggtcccatagngagacccccatctctataaaaaatataaaaattaggcagatgcggtggtgcacacctgtagccacacctacttggaggctgaggtgggagaatcacttgagcccaggagttccaggctgcagggagctgtgattgcactactgcattccaacctgggaaacagagcaagaccctgtctcaaaaagaaaaaaaaataagataaaataaattaaaaaaataaaaaagttttagtagtgatgcatttatttaaacgttcactaggaaaacgctggttttccaagtggagtcgtgatttaaagttttctttttaaaaatatgtgcactaaaaaacgttaaggctgaattggctggaagaaaaaagtaaataatcctacaggtggtaggtatgaggatcttgctaaatccggaaggtgataaggagtgaagtttggaaattttacatgctgcccctggggcaaaccagtggattcagtaaatatttgtgggttcagctcctttgcgcagcttaactctttcttccccctttcctccggtcacttccctcttctcatgccattgtcactcgctgaagtctcaggccactcaccagaagcccaccgcgttcttccaatgcgcgccctgatggtccaacagagggagccggggctccgggacggtctcctcccctgggagagcgagaagagggcatgacccccacctactctcaggtgcacgaccgctccttgcgtgtcctcccggggccgagtcagctctcattcccctcaggtgggctgcgagccagaggtggtcgttccatgagggtgggcgggaatactcaccctcggaatccgaaaagcgccgccgcgagcctgcacagcctcccatcgcatcaagttcaggtcccccgagggtccagggtcatagagtgtccaaagggggctcccacgggagggatgagggtctgcgacaggtgacaaggatcaacgcccgattgccggtcccagctccggcttgtctagggcactcgcgccccgcgatccatcaaggaagctgggggctccatctcgagcgccctacgacccaccacgccccacccatcgtactctcccccgccccgtctacagcagggaccctgaggcctgtacctttaagagcagcagaatgttctgcactatgcagaggcgtttgtcggatcacgtgacagcaccgcgtgttccccatcacgtgctcagaggttttccctacttccgggtcctctctgtcttcgctttgggccttctcggcttcggagcgtgaaaaagggaggggctggagaaccctggaaccgcaggttttaaactggagcgggtgggagcagcaagcagagccgtgaccttagatcagtggcgcccaagaccgagacagtagcctgccagcaccagttatgactgtgggaggcttcagctcctttccttcagcactcacttgccagaaacaaatatggccacctgcctactcccttttttttttttttttttttgggggnaggactgtttctggttgggaacaaagacgaccagcttcaggtcattcttatccccatctgttgaccttacaaattgttttagagacctaagtaaacataacactcatctaaagggatttcgggaatgatctattggcaggatccaagatgttaagagatccctatttccaaattatcctagaaccaaaaaatatcacaggacttcaacccctggtgttacagatgagaaaaccaaggtacaaatatatatatatatatatataacaaaattagccgggcatggtggcgcattcctgtagtcacaggtaccttggaagctgaggtgggaggatcacttgtgcccaggaggttgaagctacagtgagctatgatcacgccactgcactccagcctgggtgacagaatggaatgagactctgtctcaaaaaaaaaaaaaaaaaaaaaaaaaaaagaaccctagatttcggttgtgttggttgtaaaaggagagacccagtaagtgggggttgtgccgcagattgctacccacaatggacgggtcactgagcaggtccggccaactgggcgttccctcgctggagggccagcacaccagactgcaggtggcgcgggtcagcaaggtaccaggggatgtgtcacacacacagcccacccccggtccagtcacgcacggacaccctgggcttccgagcaaacctgctcccaggtggtgtgaccacatggagccacagacacccagcaaggacacgcagcccgcacacccccggtactccagacacagtgacctgcaccaggggctcgaggtttctctagggaacccacctcttagaatcatccagaaacaagtcactcttcatctgtccaacaaaggcctgctgagaggtgcacagtgtcttgagtccaagctgccaaggcggcaggacccccagcccagcccaggacccccagtagagtcctcacctcagcgtggaggcctgagaacgtgaggaaggagctgtccagcacggacgagtccaggcagctgtcgatgtccagcacctgctgcccggcaggtgtggggctcgggctcccagccacctgcaggacgagggcagtggtcagcgggcggcagctcagacctgctcaggacagggatgagaagccacctcctcagcagacaggacagagcccggtgccatctgacagaatgtcctagaatgctggatatatgggacatctgcaccgtccgtgatggcagcccctcgcgacgtgtgccactgaacacttgacagcagactggtgcagctaaggaacagagttttaaatttcatattttctttt

SEQ ID NO: 3980 - DNA, 4148 bp, Homo sapiens
  misc_feature (1)...(4148): n = A,T,C or G
cggacgaggcacgagtgaggggggaggcggtggcggcggccattttgagccgctgccgccattggagtgggccccccccctttcccccttcgcctcctgacaggaaaggtttaagggggacagagccctgggaggccgggccgggctcgggggccaccccgggggcccgggccatggatgtgcgccgtctgaaggtgaacgaacttcgcgaggagctgcagcgccgcggcctggacactcgaggcctcaagaccgagcttgctgagcggctgcaggcggcgttggaggccgaggagcctgacgacgagcgggagctcgacgccgacgacgaaccggggcgacccgggcacatcaacgaggaggtcgagaccgaggggggctccgagctggaggggaccgcgcagccaccgccgcccgggctgcagccgcacgcggagcccggcggctactcggggccggacggacattatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcaagccagacaggcagcaattccagagtcgaaagaggccttatgaagaaaaccggggacggggggtactttgagcaccgagaggataggaggggccgctctcctcagcctcctgcttgaagaggatgaagatgacttttgatgatacccttgttgctattgacacctataacttgcgaacctccacttcaaggtggcccgagatcggagtagtgggctatccgcttcacaattgaggggctttgcatacctgtggtcaggagcccgtgccagctatggggtcagaaggggccgtgtatgcttcgagatgaagatcaatgaggaaatctccgtgaagcaccttccgtctacagagcctgacccccacgtggtccgtatcggctggtccctggactcctgcagcacccagctaggcgaagagcctttctcctatggctatggaggcactgggaagaagtccaccaatagccggtttgaaaactacggagacaagtttgcagagaacgatgtgattggctgctttgcgggattttgaatgtggaaatgacgtggaactgtcttttaccaagaatggaaagtggatgggcaattgctttccgaatccagaaaggaagccttggggggtcaggccctctatcctcatgtcctggtgaagaattgcgcagtggagttcaacttcggacagagagcagagccctactgttctgtcctcccggggtttaccttcatccagcaccttccccttagtgagcgtatccggggcaccgttgggaccaaagagcaaggcagaatgtgagattctgatgatggtgggccatgccttgctgctggcaagaccacatgggccatcaaacatgcagcctccaacccttccaagaagtacaacatcctgggtaccaatgccatcatggataagatgcgggtgatgggcctacgccggcagcggtaactatgctggccgctgggatgtcctgatccagcaggccacccagtgcctcaaccgcctcatccagattgctgcccgcaagaaacgcaactatatcctagatcagacaaatgtttatgggtcagcccagagacgaaaaatgagaccatttgaaggcttccagcgcaaagctattgtaatttgtcccactgacgaggacctaaaagaccgaacaataaagcgaaccgacgaggaagggaaggatgtcccagatcatgcggtcttagaaatgaaagccaacttcacgttgccagatgttggggacttcctggatgaggttctgttcattgagctgcagcgggaggaagcggacaagctagtgaggcagtacaacgaggaaggccgcaaggctgggccaccccctgaaaagcgctttgacaaccgaggtggtggtggcttccggggccgcgggggtggtggtggcttccagcgctatgaaaaccgaggaccccctggaggcaaccgtggcggcttccagaaccgagggggaggcagcggtggaggaggcaactaccgaggaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcagtatgcccagcagtggaaccagtactatcagaaccagggccagtggccgccatactacgggaactacgactacgggagctactccgggaacacacaagggtgggcacaagtacacagtaggccagtgtggacccagaggcttcccgggaggcccctggccggctttcctccaccagcgcctgcctcggccccttcttcgggcccccgccagatcccgtgggtgctgggggatggggtcatcccnagggctgcctccctccaagcccactgcctcccctctgaggggctttccttcccctccatagggccaggcatttttttctggattcaaacaggcaacaatgaccttttattttctgtttgtccccacctccccaggcttccacctccctgttcttccctaccttctttcctttttgactaaaataatcccccacctcccttgatcatacagtgaggctacagtgacctgaggggagaatcccctcctgttcactctcccaaccctgctccagcccctcagcttcccagaccctcatgcagttggttgtaaattctcccaggagctgttttactggtctacttttcaggattaaaaaaaaaaatcaaaactttaaaaaaaaaaaaagtttaaaaagccaaaatggggagggggaggaagcagtgacttttttttggtaattatgtgcttttttttaatttttaggaatttgtctttttactgtggggtggggctgttgatatttcatcaagataaggcatttctttcctgaactcagggaaagaaatgcttatcttgagtttcagggtgacctgagggaagggcccccaaaacaaaacaccaacaaaacccaaacccccagaatcatctttttaaccccaactttttataccgatgcccccagttccccaataacttttgcaacacaagcttctggtgttcaagttgaatttgtaacctgctttttggtatttggagagagtgcactattgaacttggaaaccttttattccgggccgtcttggtaggtttctggtgggattccagtgggtgagagggaaggaaggggaggttgggggggctccttccccttcaagaactttggaagtttctccccaattgcctcctctcccagtgggtctccccaggtgccagacccaaaagcttttcctacgagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 3981 - DNA, 3456 bp, Homo sapiens
  misc_feature (1)...(3456): n = A,T,C or G
aaatggaattggagaaatcgatgaccaaatgtaaacactgtgcctgatatagcttgacaccaagttagccccaagtgaaataccctggcaatattaatgtgtctttccccgatattcctcaggtactccaaagattcaggtttactcacgtcatccagcagagaatggaaagtcaaatttcctgaattgctatgtgtctgggtttcatcaatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatccatctgatataacactctgcatattgggattgtcagggaatgttcgtaaagatcagattagtggcactgctgagatactgatgcacagcatggtttctgaaccagtagtttcctgcagttgagcagggcgagcagcagcattgcacaatacatatacactcttaacacttcttacctactgcttctctagcttttgtggcagcttcaggtatattagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagcttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacaggatcatgttcccttctcctgtggagtggcatgaagaaggtgtatggccccacggtatggccatattacctgaccctctacagagagggcaaaggaactgccagtatggtattgcaggataaaggcaggtngttacccacattacctgcaaggctttgatctttcttctgccatttccacattgggacatctctgctgaggagagaaaatgaaccactcttttcctttgtataatgttgttttattcttcagacagaagagaggagttatacagctctgcagacatcccattcctgtatggggaactgtgtttgcctcttagaggttcccaggccactagaggagataaagggaaacagattgttataacttgatataatgatactataatagatgtaactacaagagctccagaagtaagagagagggaggaacttggacttctctccatctttgattggagtccaaaggcttttcaatgaaattctactgcccagggtacattgatgctgaaaccccattaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctagtgttgtagcctactacacgcataggctacatggtatagcctattgctcctagactacaaacctgtacagcctgttacttgactgaatactgtggcattgtaacacaatggtaagtatttgtgtatctaaacatagaaaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacagttttggtaatgagatctgcaatccaaataaaataaattcattgctaacctttttcttttcttttcaggtttgaaggatggccgcattttgggattgggatgaatgtccaaatttctggtttgcttgcttttttaatattggatatgcttatacacttacactttatgcacgcacaaaaatgtaggggttataataatgttaaccatgggccatggatcttcttttataattctacttttgagtgctgtctccatgtgctgatgtatctcgaggcagtcttgctccaccaggtagctctagggagggctgggcaaccttagaggtaggggagcagagaattcctcttatcccaacatccaacatcttggtcagattttaacctcttcaatctcttgcccctcaaagcctggttaaaaaaggttaagccgtgcataaggttaaacttccaattttaccatactccngcctttacatactctgcttagaatttacatactctgcttacgaatttgggggaaaaatttagaaacatataattgacaggacttattgggaaatttgggtaataatggatggaaccattttggccatataagatttcatatttactttcttatacatttgtataaagtaaggccatggtgtgtggtgtaatctggtgttattttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatgggcatagttgggggtgacacagctgtctagtggggaggccagccttctatattttagccagcgttctttcctgcgggccaggtcatgaggagtatgcagactctaagagggagcaaaagtatctgaaggatttaatattttagcaaggaatagatatacagtcatcccttggtctctctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatctatgc

SEQ ID NO: 3982 - DNA, 3065 bp, Homo sapiens
agacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacgatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgcggtcttgcgagtggctggttccctgcagaagagcacagaagtgatgaaggccatgcaaagtcttgtgaagattccagagattcaggccaccatgagggagttgtccaaagaaatgatgaaggctgggatcatagaggagatgttagaggacacttttgaaagcatggacgatcaggaagaaatggaggaagaagcagaaatggaaattgacagaattctctttgaaattacagcaggggccttgggcaaagcacccagtaaagtgactgatgcccttccagagccagaacctccaggagcgatggctgcctcagaggatgaggaggaggaggaagaggctctggaggccatgcagtcccggctggccacactccgcagctaggggctgcctaccccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaatttttgctttagcacttggccccattgtagattgccctgtgcagtaaactttcaaggtgtcggctgccccagattgcttcatttgctgggtgtggaaagagttgctatggccaggcatatgggatttggaagctcagcagaagtgacttctgctctgtggttgctgctccccggctttcacagacatggtatggcagccattcttttatctatttaaccaagaggatgctggggaattgtgctgcttgtcctgttggctggtggctgcattatgtcctggggtgtgcatgtgggtctatttagagcttctgtcccttccttcccattgcaagttgcacccagatgagacagctgtagtactaggtctctttcacctctcattgcctgtccctgcttcgagctggttgtcttgtgcgtgggacatgggccttcctatctgtgttttctcaaagtcaggagctgaccaggagcacactaaggtgtggtcatgcatcataaccaacattcactcatctgggacattcttaagatacatttataaatcatttcagcagtagtactttgtatgtgttgagagtttacagagctctttgacatacgcgatcttagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtctcatcatacaaaatggcaatcttggctgggtgcggtggttcatgcctataatcccagtgctttacaaggctgaggcaggaggctctcttgagaataggagttcaagaccagcctgggcaacatagcaagatcctgtctctccaaaaaaaaaaaaaaaaaaaaaaaaaaatttcatttttgagtccagaggccctcctattactcttgatttcatcttcagagtgtagttaaaaaattattttaaataattatttttttaaatcagttgtaggttcacagcaaaagtggacaaaaagaaatttctcatatatcccctgccctcacacatgcatagcctcccaccactatcagtatcccacaccagagtggtacatttgttacaatcaataaacctccattgacacatcattatcacccaaagtccatagtttacatgaagattcactctggtgttgtacattgtatgggcttagacaaatgtatgatgatatctacaattatagaatcatacagaataggttcactggcctaaaacctccccaaggcttaacctggttcatccctttcttccctaatcccctgggcaaccactttaaaaaaaaaattaggttcagggggtacatgtgcaggtaaactcgtgacaagggggtttgttatacagattatttagtgacccaggtactaagcctagtacccaatagttacttttctggtcctgtcccttttcccaccctccaccctcaggtaggccccagtatgttattcctttgtgtccatgttatttcactcccacttgtgagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggatcataaa

SEQ ID NO: 3983 - DNA, 559 bp, Homo sapiens
ccttgagggaatctgcccctcgagcctaagattccgccccggggtttaaatcacagcagggcccttggccaagccacccagtaagttgaataataaacccccagagccagaacctccaggagcgatggctgcctcagaggatgaggaggaggaggaagaggctctggaggccatgcagtcccggctggccacactccgcagctaggggctgcctcacccgctgggtgtgcacacactcctctcaagagctgccattttatgtgtctcttgcactacacctctgttgtgaggactaccattttggagaaggttctgtttgtctcttttcattctctgcccaggttttgggatcgcaaagggattgttcttataaaagtggcataaataaatgcatcatttttaggagtatagacagatatatcttattgtggggaggggaaagaaatccatctgctcatgaagcacttctgaaaatataggtgattgcctgaatgtcgaagactctacttttgtctataaaacactatataaatgaattttaataaaaaaaaaaaaaaaa

SEQ ID NO: 3984 - DNA, 503 bp, Homo sapiens
agacgggttcagttcgtcatggggctgtttggaaagacccaggagaagccgcccaaagaactggtcaatgagtggtcattgaagataagaaaggaaatgagagttgttgacaggcaaataagggatatccaaagagaagaagaaaaagtgaaacggatctgtgaaagatgctgccaagaagggccagaaggatgtctgcatagttctggccaaggagatgatcaggtcaaggaaggctgtgagcaagctgtatgcatccaaagcacacatgaactcagtgctcatggggatgaagaaccagctcgagacggggttttaccatgttgcccaggatggtcttgaactgctgagctcaagtgatccactgcctcagtcttccaaagtgctgggattatagttgtgagccgctgcacctggcccagaactaatacaatttaacgttttgttgtatttgcctgcttctatattatatatatataaaaaaagcattattacaaaaaaaa

SEQ ID NO: 3985 - DNA, 388 bp, Homo sapiens
gcacgagccggaaggggcaagacgggttcagttcgtcatggggctgtttggaaagacccaggagaagccgcccaaagaactggctggagtgcagtggcgtgatctcagctcgctgcaacctccaccttccagccacctgccttggcctcccaaagtgctaagattacagcctctgcccggccgccaccccgtctgggaagtgaggagcgtatcagcccagccgcccattgtctgggaagtgagaagcgcctctgcccggccgccccgtctgggaggcgaggagcgcctctgcccggccgccccatctgggaggcgaggagcgcctcttcccggccaccccgcctgggaggcgaggagcacctctgcccggccgccccgtctgggaggc

SEQ ID NO: 3986 - DNA, 514 bp, Homo sapiens
  misc_feature (1)...(514): n = A,T,C or G
ggttgcagtgagctgagatcgcaccactgcactccagcctgggggacacagcgagactccggctcaaaaaaaaaaaaaaaaatatatatatatatatacacacacacacacacacacataaatacatattcattgggaaggggagacagagatcctgaagagggccccttaaattcctcaagtggctcccagctgccctggcgaaggccaccctcatgccctccctggggagaatatcgccgtgtctgtggatagtcccttccagcattattgacattgatgcatcatcttgtcacttaggtgaccaggggcagctgggaaatgattcggcaggaaggccgaattgccggcctttttctcagccctgattccctgtgggcaggtgctgggttttcccctggggcctcctgctctgggttgagatgtcgcatgagaagagcagaaggcagattngngcagggccttcccnacaccccgtccactttactagatgcctctggactctgaatttttt

SEQ ID NO: 3987 - DNA, 425 bp, Homo sapiens
  misc_feature (1)...(425): n = A,T,C or G
gaaattgtacagtagtacaataatacattctaatccatagtttatattcaaatttcatctcttgtctcaaggatgtccttcatagtgtttcgttccccctagtccagtatcaagttgtcatgcctctctggcctttttaatctgggttggtttcttagtctttcatgaccttggctttggcctggggctggggcgttaaaaagtacagaccaattattttgtacagngtcctttgatgtggggattgtctgatgtnttcttgtgtcctctttgggatcatgtatttttcagaagattgcnatagaagtaattgatatgtccntttcaatgtgtcttatcagaagggtgtgatgtcactttgtcctataaccagtaatgttaactctgaccacttcgttaagggtgggttctaccaggnctgtcca

SEQ ID NO: 3988 - DNA, 410 bp, Homo sapiens
ggaaggcagagcttgcagtgagccgagatcacgccactgcactccagcctgggcgacagagcaagactctgtctcaaaaaataaaaaaaaaaagaaagaaatttgtgtcgtatgaagtcccacagtttgtgggacattatttccagctgcaattggaaatgaatgctgatggattgctggatagatagagggatggacggatgtggaataaaacaagtatagacaaaggtgggtggtggactgtaggctgtgggtatacaagtgttcacttcaaactttacttggctgggagtgggggcccatgcctgtaatctcagcactttgggaggccgaggcgggtggatcacttgaggtcaggagttcgagaccagtcttgccaacatggtgaaactccatctctacaaaaatac

SEQ ID NO: 3989 - DNA, 932 bp, Homo sapiens
  misc_feature (1)...(932): n = A,T,C or G
gcggccgcctactactactaaatttgcccccggtcgactttttttttttttttttttttgcagagagagagtcttgctatgttgaccaggctggtcttgaattcctgggctcaggcgatcctcctgctgtgccctcctaaagtgtagggatcacaggcatgagtcatcacatccagccaaaatctatcttttatctcaccgcaagcttttaattcatttccaactattaggaattagtttgtttcataagcctgagatatgtgcaggatttttgaaagatgatttctgtcagtgtggaagcatgttgcctccagcagtcgttaaaactttcaccagcttgtctaagagtttgattcaatgtctcatcgtcctccgacatgctactcttgctagtaaacaagcaaaaggaaactgctagggctcagggtttgggtgctactgagtgtttacaaatactcgagctgtagacaagcaaatgttccctgacacagaaggaagaagtgtgcaggatattcctctttatcctcagctctgctgagagagagagagagagagagagagagagagagagagagtgtgtgtgtgtgtgtgtgtgttggggacaatcacttgcttcagaagacagtattgtgtgatacaaggaatatctggagtcagacagaactgtgtccaaattccagctctgtctgaccctgacctgttcctcttcttggtctcagcgtccttcactctaacacttgggtagtgagacctaccctgagggtcactgagaggaataaaggggccatgtgtgtataaagtatatacccagaacctagtggatgttcagcacggggatttcttaccttctctttaggaagtaggggacatcgtaaggctttgtccatccctatttttattnggtctccctcttggggcaggaancccttaaa

SEQ ID NO: 3990 - DNA, 281 bp, Homo sapiens
  misc_feature (1)...(281): n = A,T,C or G
ggaggttttttttttnttttctttttttttgcagagagagagtgtgtgtgtgtgtnttggggacaatcacttgcttcagaagacagtattgtgtgatacaaggaatatctggagtcagacagaactgtgtccaaattccagctctgtctgaccctgacctgttcctcttcttggtctcagcgtccttcactctaacacttgggtagtgagacctaccctgagggtcactgagaggantaaaggggccatgtgtgtataaagtatatacccagaacctagtg

SEQ ID NO: 3991 - DNA, 470 bp, Homo sapiens
agagtttccctcattctggagcttctgactccccactcccaactctgagagtcgttctccttcccataggctatgcagtctcatacagctgggctgcagtgccacacctcaccagtaggtgctgccttcagctcaatgtgactccagcctgagcttcgagctgtgggtgctaagaagtggctaccccctggctgggcgcggtggctcacgcctgtaatcccagcactttgggaggccaaggcaaatggatcacgaagtcaggagttcaagaccaagtctggccaagatggtgaaaccccaatctctactaaaaatacaaaacttagctgagtgtggtggcaagtgcctgtaaatcccagctactagagaggctgaggcagagaatcgcttgaacccgggaggcagaggttgcagtgagccaagatctcaccactgcactccagcctgggcaagactctgtctcaaaaaaa

SEQ ID NO: 3992 - DNA, 440 bp, Homo sapiens
cggcacgagctcagcttctcaggaggctgaggcagaaggatcacttgagcccaggaggtggcggttgcagtgagccgtgattgtaccactgcactccagcctgggtgacagagcaagaccctgtctcaaaaacaacaacaacaaaaaacagcttcctctgctcagggtccgtccaaaagggcatctcctgagaattacaggccactggcttttaacctgacatttcaaaactgtgccccacacccaaggggtttctgcagtcctctcaaaggatactgaattaggatttagggagaaggagagacccagctttgggagatttgatgtcagaactgtgttttctgtgtgttccagtgtgacaggaagtcccttcctggagcttatcctctcgcattcggggtgcctggcccagggagctccttgattcctaaattcctgct

SEQ ID NO: 3993 - DNA, 741 bp, Homo sapiens
tttttttcttttaatttagaaagtttattttgccaaggttgaggacacactgtgacacagactcaggaagtcctgatgacatgtggccaagatggttggggcataccttggttttatacattttagggagacataagacattaatcaatatatgtaagaagaacattggttcagtggggagggagcttccaggtcacagataggtgagacacaaacagttgcattcttttgagtttctgattagcctttccaaaggaggcaatcagatatgtatctatctcagtgagcagagagataactttgaatagagtgggaggtgggtttgccctaagaagtttccctaagcttgagttttccttagtgattctggggccccaagatattttcctgtcacagttgacatccccaacacagtgtttagggctcagaaaaagataccctaaaatagggtgctttggcatgctgagtgctttgaataaaggagactgaagggcctcagaaataagagaacaaaggtctatctctgacccactgctgcccacctcccttcccttccaaagcacagggagggattttctttgaagttctcttatttgattaagggaagtttctccagaaggaaggtaattgtcctggacaccccttcctggaatctacatcgatcagagaagattaactcatattgcaggacgggagaataattaaaagttgctcaagacagcacacctagatagacttttt

SEQ ID NO: 3994 - DNA, 455 bp, Homo sapiens
  misc_feature (1)...(455): n = A,T,C or G
nctttttttttttttctttcttacttttctttctttttcttttttctttcttacttttctttctttttctttctctctctctctctttctctttctttttccttccttccttccatctttccctttctttctttctttctttctctctctttctttctttctttctctctttctttcagacagggtctcaagaaaacaaaatcatccttcaagtaggacacagtaggaactttggcctggggcgtcagtgtatgtcgctactaactgcacagaacaatgtgcagggaaagactactgttcccttcctaagagctgtaaggagccaggagatcacaggcctgagggtattaataacagaagctggtaccccccacttcatttttggctgtcacacgactggcatgcccaactgatatttagtaggcggaaaccaaaaatgctgaacatcctacaat

SEQ ID NO: 3995 - DNA, 704 bp, Homo sapiens
ctgaaaaggatgcatgtcgcttcaggaccatgtgataactgtgttaactgcacaaattatacagcatgtgtttgagcaatatgaaatctgagcaccttgaaaaaagaacaggataacagcaattgttcagggaataagagagagaaccttaaactctgaccgccggtgagccaggcagaacagagccgtatttctcttctttcaaaagcaaatgggagaaatatcgctgaattcttattctcagcatggaacgtccctgagaaagagaatacgcgcctggaggtattggcttataaacagcccccctgggcgtggcctgtctcttatggttgaggctgcaggggtgaaatagaccccagtctcccatagcgctcccaggcttattaggaagaggaaattcccgcctaataaattgtggtcagaccggttgatctcaaaactctatctcctgataagatgttatcaatgacaatagtgcccgaaatttcattagcaattttaatttcgcctcggtcctgtggtcctgtgatctcgccctgcctccacttgccttgtgatattctattaccctgttaagtacttgatgtctgtcacccacacctattcgcacactccctccccttttgaaaatccctaataaaaacttgctggtttttgtggcttgtggggcatcacggatcctaccaacgtgtgatgtctccccc

SEQ ID NO: 3996 - DNA, 595 bp, Homo sapiens
ggtctttacttaaatctcctcaatcctgtccagctgaggaggattgtataattgccctcaaggacccttgtaataaattgccattaaactgccaccaaattgttacagccatgtgtgtttgagcaatatgaaatctgggcaccctgaaaaaagaacaggataacagcaattgttcagggaataagagagataaccttaaactctgaccgccggtgagccgggcggaacagagccatatttctcttctttcaaaagcaaatgggagaaatatcgctgaattctttttctcagcatggaacatccctgagaaagagaatgcgcccctgggggtaggtctctgaactggccccctcggggtgtagccatctcttttatggtcgaggactgcaggggtgaaataaaccccagtctcccatagcgctcccaggcttattaggaagaggaaattcccgcctaataaattttggtcagacccggttgctctcaaaccctgtctcctgataagatgttatcaatgacaatggtgcctgaaaccttctttagcaattttaatttcgcctccatcctgtggtcctgtgatctcgccctgcctcca

SEQ ID NO: 3997 - DNA, 449 bp, Homo sapiens
  misc_feature (1)...(449): n = A,T,C or G
aaaagaacaggataacagcaattgttcagggaataagagagataaccttaaactctgaccgccggtgagccgggcggaacagagccatatttctcttctttcaaaagcaaatgggagaaatatcgctgaattctttttctcagcaaggaacatccctgagaaagagaatgcacccctgagggtgggcctctgaaatggcctccttcagggcgtggccgtcttctatggtcgcagactgtggggatgaaataagccccagtctcccagagcgctcccaggcttattaggacgaggaaattcccgcctaataaattgtggtcagaccggttgctctcaaaacacaaattttaaactcaaccaagctgtgataagtggaatggttactgtttatactgtggtatgtttntgattacagcagataatgctttcttttccagtcgtctttgaga

SEQ ID NO: 3998 - DNA, 14728 bp, Homo sapiens
agatgggatctggctgatgtctgtccctgagggggcagagagcctgggaatcgcatacaaggatgtgttcgtacacacccgtgctcgcgtgtctggagcagggctgcctgggaggccggctggggacgtgacaatctttgctatgtactcagggagggggagggggtgtgcatgaacctgggagggaggaagtggggagagccagctgcagccagctgttggaagtccgctggggaagcaagcagcccccgggcagctggctggggaccctggcccctcatgctatccaccgccggccccccagcttcccagcccggacaccgccagctcctgaactttcatgccctcaaagcccagcctctgccagggtcccacccctgtttacagagctacccggccttgaaagggacactggggacccaggcagggcgccacagggtacaaagcttgacctgtgactgctagaggtcgcagggtgaattgggcaaagggtggcccgtgtgggtgttgtgtggggccggatggcttcacagggaaggtgaaggtgggaggctgagtctgccaaataagagagatgggcatgggcccaggatgtgccacacagcagggggtcccatgggggtcagcgggggagatggagcagggctgggagcagatggatgcagggcacgggctcaggaacgagaccgtttccagctgctgagactcggggagggggctccctgaaacagcctcatccctccacccctctcaccccacggggaggaggctcagaaaagacagaggcgtgtgggtcccaggcagggcctgtttatcctgagagcgcgcatgcgctatggcttacgaggcaacagcggtgccggtcgatcggtggtcggttcgggggtgcggggcccgggagggaagtgcaaagtcaacagggtgtccacgggggagcccgccaagcagggctgagccagaggccaggcgtccttcccgggtgccgctctcacacacctacgttccccaggcctgggagctgccgcgcggaatgaggggcctgtccaaaggccgccctcctcggggacttggggcctccatcctcaggcccctcggaaagcccaggcccccagcagggcacaggcgcacagggtacctgggtggggagcagggtgtggcctagggacccccacaccagggcaggtgggcaggggcagctcctacggccacatcaggcctccctggccttacccaaggtccccacaaaaaggctgggcgccccaacttggccactgggaagtcccagggactcccactcaggacggccgctgctgaggggagggggcggggaggaaatggtttgcagagaaaggtttgttttattgcaattatttagagcgcgtcccaagggggaggggaagggggaggggaaggggggggggtctctggtattaagtggaaacatgtgtggagctggagatctttttggaaaaaaagcaaaaacacaaattcctttcagtcagcaggccccggcagagcagcaaaggccctcgccccgcggctgccgcgcgctcgctcgctctctctctgtctctctctgtgtctctctctctctctctctgtctctgtctctgactctctctcacatctctgggtctctctccccctatcttgctgccacaggcccccagtacctggtgggcaggggcaggatgggggctcaccggggctggggctgatttctgggcaatggcaggaccaccctccagtccactgaggctgggggagctcggggcaggctgaggcccaaggtccgtgcgggaggggtcccagggtcccgagacaggcaggaaggggctcagaagttgctgaagatttcacgcttcctgttccagtccatctgtggcgcgcgcttgttgactcgcatggctcgagccttctccttggcctcggccgccgtggggctcaggtggaggccgctctcctggaagggatcttgcttccaggcactgccatcctggggtgagcacggtgggtggggtgtctggagtgagccctagtcccacaccccagacggtggcccctcctagggagcaaccaacagaggctgcctgctggggctggggctcacgaggacttcctgaacagagaccccactgcccgggctgacatctccacagacgcctaccccaaggcctctagcaaccccacgtgtgagctcaggagtggagaacatccatacctcagtgtccttgtcggaaccaggcaggtcacttcgggacgagcacgcagagccaccattgagctgggaaaccaagggcagattgtggtttcacagacacacacaacacctgcacacgcacacatgtgcacagaggcacacccccccccagtgtgtgctcctccactcggcagggggcctcgggcctctggtggactccagatgcggcggggcaggcaccgggcgcctggcagtgacaggcaggtggcctggccggctcatggtgcagagggggttcaggtgcaggaatggccggcgtgagcaacgcctggggtgaggccaccgccagctccctgaggaggcagagactggagggcaactccttaccaggtggtgcccaggagaggacagaaggcagtggccccgaccccaggggccccacgtggcttgtgtgtggcacgacccaggatgagacccacaggggcattaaagggaggtgacagggctaaaatcgggtgtcactagcacacctcgaggacggatctccagggagaagggggcctctgtcgggcctgggtacccccagaggcaccctgtgtctcatgggcaccccaccctcttacctgggcagggctggttccattggtgacgggtgacggcagaggacctgtggggacagcgtgtcagtggctgctcagccaccacaccgcacccaccctgtgccctgggccgtggcccaccttccacgtgctcctcggtgggtgtgacccgaagccgcttgaagtgttcatctgtctcggggtccacgaccagcagccgggcctcgtcctcccgtgccttgatgctggccaccacctcagcatggcgcagtccctccacattctgcccgttcacctgccgccaccagcatgtatcagccccgccatgggcccagacagcccccaacgccgcgtggccaggtgtggcatcaaatattcatcacagccaccgcccaccgaggcagcaggaggcgcaccagctcaggttcccagcgtctccctcctccctgcaaggacccagggccccagtgtggacaggtgcggggcactcggcaccccgcagccctggtgggccggtacctcaatgagccggtcctgggcgcggaggccagagcgggcggcaggtgagcccgggtccacagagcggatgtactggccgggccgggacttgtcactatgcaggttgaacccatagccctgaggtccctttcgcaggtggcagagccgagggcgcagctccctcaggggcccactgacatcctgcaggcccaacggacagggtcagtctcttgctccagcctcccgcctccagaggccactccccggtggtgccgccactgcccaaactcggtaccgtgccccccacgggcaggcccaggtctcagtggcaaacactccgggcacccaggctgcctgtgacagagctttagctgtgggaacttgggcaaagcctgttttcaaacccagaagcctccccgacgggcccagccgccttcccgggttgctgggagaattcctttggctcgaggccagcgtggcgcacaggcagggtgggaggaagcaccaggtgggatgaactgtcgccgtcggcctcctggggcggttgtccctgagggctctgcctgtgcgtccccctgccccgggctctcctccagagcgtggggcaggcgctcctaggccagcagttttgttttctctccagaggcctccgtggggctggctgcggtggcggctctgtttgctttcacattccaggaaaatgagccgccccacccccgtgggcccagcaagcaggggctggggcaggagcttagtgtggacagggcacagagggcctcctggtgcccggaaggaccccccgctaccatcccaggccctgccccatgttacctctggcatcctgcggtagggctctgggccaggggaccatgcaggcaaggccaggcccaatgaccacctcccagccagggggtgggccagggtgcggcggcggtggccagcggctgcccgtgctcagttaaacatggcggtggccggagcaggcaggaggcagctcaggtttccagggagcgccaagcttgagggcgtgcgcaggggagactgtgcaggcgggctgggggctgccagggcccttccctcacctcctacctccctgtgtgtccctgagggaccacaggccaggccaggccagggctggggcggcatggcaagggggcgctcagacctcaggagggcaggtctccaggcctcagacacccccaacccctccagccacccaccttcaagctcgctccaaaccccaatggaccagaaacggccatgtcagcgggggggaccgccccgccaagggagcaagggggtccttctccacacagctagtgctctgtcccctgggctcaggacctgcccttggtctggaacacccttctcctgtccagcctgccagatgcctcatctgaagcctcctgcccaccctctgaaccctctctgcatggccaccacccagcccgtcacaccagaaactccagggacaagcctgtggctccctggccccacaggggctcagctgggccacatgggctgaattggagggtgcaagacccccaaaatctccagggccccaccacatagactcactcctcccccagacacacctggtggcacaggcgtggggcttcaaggctgaccctgacacctgcccaccaaagtgcccctcagggatgcagtcacagcacggcccccaggctggcctgggacgcagggaaggcgtggggacaggagtccagttcgggaggggaagtggagcacagcccccaggctggcctgggacggagggaaggcgtggggacaggagcccagttcgggaggggaggtggagcacggcccccaggctggcctgggacggagggaaggcgtggggacaggagtccagttcgggaggggaggtggagcacggcccccaggctggcctgggacggagggaaggcgtggggacaggagcccagttcgggaggggaggtggagcacggcccccaggctggcctgggacggagggaaggcgtggggacaggagtccagttcgggaggggaggtggagcacggcccccaggctggcctgggacggagggaaggcgtggggacaggagtccagttcgggaggggaggtggagcacggcccccaggctggcctgggacgcagggaaggcgtggggacaggagcccaattcagtggaggaggtgggagcgtgatatgggcccagtccgcaaagacacatcacacagccacagacacaagacgtccacacacacctgcaaacacgcacagcagcccacacatgcggccagccccacagtgctggcccggcagcccttcccacgcctgcacagcggcctgcggagcagggtttctcagggcaccagacaggaagcaggatctggtgggtgtctggggccctgaggccaggccaaggacccctcagtgttctcagggtcattctggccacccctctgcctctgtccagaagcagccgtctttcactctacaaggcaagaagttctgcctatcaaacctaaaccccttcattgtcagcagggtcccagtggcgccaggcacagcactaaaacctcaggtggaggggctgcaatggaggggccagggtgggctgctggcagcacatgggctcgtggggaaggggggcccagagagccgaggagctcgggcggcgttcatagctcacattcctcctccctgccctggctcagcacacacttcctgccgcctcccgccaggccctcgggctcccacgggctccaggctccctccctgccggcggccagcacagagctggaccatccctggtcccccagccatgcctgtgtccggacaaagaggctggcatgggggtaccctgggcacccccccagatggtgacgcaccagccctggcagagaaaggccttcattgttgctcagcgaccagcctgcttacatcaaggtcccggagtcccctccttccaccccgggaggctgagcggctgccggttcctcctagccctcccttcctcccaccccacctgacctgtaccagcctctggggtgggctccgtggaggggctcccggagcccgggcaggtggcgtggcactcccggagcgtgccatgacagcggcacagtgacagcaagtggcaggcgtccggccggggtggcctgaactctctggccgacccaggctgccaccccacttatctacctccctctgcggccctggctccccggggatgggtggggacgtgggggctgagtcactctggggagcagggtgatgactgagcccgctcccctgcgaaggctccagcccggcgccccccacccagctaggcttccgtcccaagaaaggaaggaaggaagctgctggaaggccctgccctgccccaggacccagggctgaggggacagggaggagtcccggccccagaacacaggacggtcctgttgaggctccagaggagcaagagccagggaagcccggaagcccccgcaggcaccgcgccccaaccacacagccgcctcccgcagaactgtcacccctcacacctgctcttagcccccaaggccctccagatgggggtggagacatgggctaggggcagggggcagagggctcagggtctgccaccacctccagggcctggcaccgctggccaccccgtctctgtttgggggctgtcccctgtcgtcactactaggatcagctgcactgcagctgcggccacccccagcctggtgtggcccagggctgagtcatcactaactaggccttcacggcccccaaaaggaggggccaaccacatcagtgtcctcccctgcccacctcccctatccccagccaggacagaggacactgagagccacccttagctcccagggggcacccaaagttgggccctctccatccttcaccaaagacaaactacacacatcccttccagagctctgcctctctgccaccagtgcccccactggagccatccccgcaaggtaagctttgccctcctgggctccctgaccatctgaggcatgccctgaacccaggctgagaagggcaggatctgagcctgctctgtggaggtcaggtgaggcccacctcttcctgcccatgctgggagctcaggtgaagaaacctcaggtcctgagccaggcgcaggggctcacacctgtaatcccagcactttgggaggctgaggcaggcggatcacttgagcccaagagtttgagaccagcctggccaacacggtgaaaccctgtctctaccaaaaacacaaaaattagccaggtgtggtggtacacgcctgtaatcccagctactcagcaggctgagacataagaattgcttgaacccaggaggcggagcttgcagtgagccgagatcgcaccacagcactccagcctgggcgacagagtgaaactccgtctcaaaaaaaaaaaaaaagaaagaaagaaatgaaacctcagacctcaggggccgggtacagtggctcacacctgtaatcccagaactttgggaggtcgaggagggcacatcacctgagatcaggagttcgagaccagcttgagcaacatggtgaaaccccgtctctactaaaaacacaaaaattagtcaggtgtggtggtgcgcgcctgtaatcccagctactggggagggtgaggcaagagaatcgcttgaacccagacagcggaggttgtagtgagccaagaaagaaaaagaaaaagaaacctcaggtcttgatgccagaagagagaaggggagaccctgttccttgggtgccccctgacctcctggagcccctgtccccagccagactcatgcacaaagggacctgccactcaggccaccctttgttcctctaaaaatacacccagaggaagcccctcctagggcttcctgcagcccccagagcctgaaatagcagagggggaaggtcccacccaaggcaaggtgcctgggccactgcaccctccagataaagtccgagggccggatttttccacaggaaggtgaaccatgcgtttgtgtccaaatcaatggacaaacgcctgaggcagagggggagcttcctcctgggggagggaaggtggctgggaaagagggaggccccaaccctcagcctggagacaggggcttaggaccagccagcccccctgcaaggccagcccccccaccagccctgggctgggcaccttggccctgagcaccactgtggcccgccctcaagccccaggaacaaaacgggtcccacaggtcccacgggcaggcctgcgcccaggctgggctccccacagggaatgctgtctccctgccaagccgctccccccgggctcagctcctaggggcagccagcttcagcagtgacgtctgggaaagggagaaagtgaatgtgtatatcccctgcaccctcagaactccagatcccacacccctgccccaagcgcggttctcacagtggggtctggccaacccctggactcatatcccctgaagggatttctttcttttcctttttttgtttttttttgagacagtctcactctgtcgcctaggctggagtgctatggcgggatctcggctcactgaaacctccgcctgccgggttcaagcgactctcctgcctcagcctcccaagtagctgggactataggcgtgccccaccatgcccaactgatttttgtatttttagtagagacgggggtttcaccacattagtcaagctggtctcaaaattcctgacctcaggtgatccacccatctcagcctcccgaagtgttgggattacaggcgtgagccaccgcacccggccagggttctctttgaaaatgaaaaaaaaaaaaaaaaaaaggtaggagagaacatggagataatgccatcagggcctccaggaagataagacagacagcttcaggctgttcctcctggtccccaaggcctgccaggccgcccctcccagtcggccacctagcaggaggtggagcaggccgcccctgtacttttctgggtctcctggctgggagcaagggcaggggaaggaggaagtactacccagcaggagtccaggaggaacagcagacagggtcccagggccctcccttgtatctagggggaggagtgggctcaccctggagcctcctggacccccaactccactcccatgctcccagccccacctacgccaggcctggcagagtggcctcctaggcttccccaaccacggcgctgcctgtggagaaggccggccctctcccaggccttcccagcatgcaggcgccttcaacagagacaaagacagagccacggatgacacccagcacaggcacagagctgcgcacacgcagacctggaatgcctcttcccagggttcctcagccacgaggctgggggctggggaggcggcagcttgtcagagtgacccctcgatagggcaagtggctctggagcatcctggagaagaggaacaggccaggctgccctgaccctacccagtttaaaacacaggctgagggtagaaacagtggcccccagtggccaacaagatggtccctggggcagaaaaggagccccaaaaggcagaagagaccaagacttctggaggtgaccaaaggcaaagatcgtcgtcaaaagctgagagagcctctgggagaggctagggtggtccctgtgggccaagcccgccataccttcttgccagcttcggagctgtggctgccggtgtgtgcccagtctggcttcggctcccaggggtcgtgggcgggtgggagccctcgctgggccatctcctcggtacaggtcagctgccgccggcggagctcctcatctgtctcctggtccaccaccagcagccgagtctgcccctccacagccttgatcctttgcaccacctggggcgaatgggcgataggagcgggtcagtggcccacattccgggcagcacatgggcagtggcaccactctgggctggcccaggcgtgcggacaggcggctggtctgcatgggcgggtggctgcaccaagaggcctgccggccccgccccccacccccggactccagcggctccctccctctgcactcaggctccggacactgaggcccaggctgtgagggcttcagggtgctcccagagccttgcccttagcccagggtcttctccaggcggggctgggaaggggctgcaggatagggccgctgggtaagtcctgtctggaagtgacaaaaatggtgcacagtggaccttcaggttttcagtctgcctgtccctgtgcgcgcatgcatccatctgtttcaaagtctgtgtctccgtccaggtttgaaggagaggtgtgtctccctgggccccagtttgagtgtgtctgtgcccattcccgtcattctctgccgtgcagtgtgggagtctaaactcctgaccctaggccttatatctacctccaggccatggccatgggcccattccctctggatctgcagagaggggaagggctgggctcctggctcgggcacccacacacagccagggaagcaggattcaggtgcagccggcgagggggagaggcaggtgcacctgtggacagctgtggcttggtggccgtcggtgtgtgcgtgcaggtgcctgtgaagtgtctggaccacgcggggggccagcgcacacccgcggagagaaagcagtgcccactgggaagtgggcaggaagaggggcagccctactcccacctgcggcctgggggagggtggacaaggctccccaccagctgccgggctcagcaggggtggtgaacagataggagggactgagccaggcccatcttcccccagccctcctctctccccatgacccagagtgagacaagaggaacccagtgcccagctgcttcttgactatgtgtcccagacaagttaccctcaatctctggcatcagtttcctcaactgtcaaatggggcagtaactgcccctcttgccctcctggggcagtggggagagtccaccatggtctgtgtgtccagtcctcagagaccagccccacagggccttggaaaagcaggtgttcccagggcgagggtggcagtgactatccaacagcagcctggccccagccctggcagccctaccctcaatccctcaggtccaggcccctggcctgatccccacattcttcagcaaacaaccttacacagcagacactctgggtggaaggcatggggccggccgacagagtgacagacaaggcaccaggtaaacaggagaccagctccaggtccagctgaaccaacctgctaatctttaggttccaggaccagccatgtagacaggttatggattcatcggtgctgtgagggacaggggacctggaggaaaaggggtgtgtggacgctggaccccaaccagggtctggagggagtccctggcctgtgggagacagacacacctcaggggtcagaacccacagagaaaaggctctgttctccttagccaggaggcaggaggcttcggccagtaaccccagccaggctaggcagcctctgaggaggagtagtgcctttgtagctaaggaatgtggttgccagcaatggccaactcagcccggtcccagacacaccagctgggacacactagagtacagacacaaagactcaccggcctgcagacagtgatgagtacactagccaggcgtgcacacacacagagcccagctcccatacgcccaggagtccagacctgcacacacacaggcacacgtgcagacctgtatactcacacacacactacagcacacacaggtgcagacacactgatgcctttactgcgacccctcctgggtacgcacaggcaggcgcatgcacacatggctgaccccaaagggacctgcatacacacgcccagctgtgttcacacgcacacgtgtacacacacacccaggcaaaagcacccaggtcttcacctttccggaggggctccaggcggcccaacaccctccttcacggcacactgaggccaaaacgcgaccaaagggcgaggccagcggccaggagccgcagtgcgggcccctccctgccaggatgcccccccccacccccgtgcaggactgagcttcctgcgccgggactccgaaggcgccgggccgctgcctcccgacaacgtccgcgtcctccccgcgggagccccctcgggcccccgtgcgacccctgctcgccccagggggacgcgctcggggagggggcggcgggccgggggcgagcgctggcccccacctggtggtgcgtctcgccctccacgttgacgccgttgacctcgaccaggcggtccccagcgcgcagcgcggcggcctcggcgggggaaccgggttccacgcgccggatgaactgcccgcggcggcccttctcgccgtgcaggtggaagccgtagccctgctctccgcgcaccaagcggcacaggcgcggccgcagcggctccggcgcggccatggcgcccgctgcccaccggccgcccgcgggcaggggcgcgggggagctcgggggcggcggcggcgctgggcacccggcggtggcttcagcggcggctcctgttcggctcccgtcgcctcgggatccggctcgggctccggctcgggctgcggcaccgcctccgcgcccgccccttccccgcccccgccgcccggccgcccccgcctccagtcccagccgtcccggccaggcccctacctccgcgcccggccagcccgaggcggggcagggggaggcggcagggctaggggaccccttaaccaccgggacctctctgtctcgcccctactctgggcagccgccttggtgccagcgcctttgccttctatcccaggaacatttattggatacctactgtatgcgcagcatcgaggcaggtcttgaggtgggcgacgggttggacaaagggtctccaggccaagggaccccgacaaaggggccaaagggtaagaacaagggccacagccctccccaccctccccgggaagcccttccggacccccttgcctgtctcctctcggctgtgtctcacctggatccctcccagccagtggctgggagactccctggcccagggcagagtctcaggagggcccaggaggcaaaaagggctttaaaagtgacacgcagcagcccctccctgcatcctgggggccagtggctgggagactccctggcctacccaccgtgttcggcctatctgcaccgcgtcggttcccacgccctgctgccattctttcccttggccgggccggccccctcacttgtgtcccagcccaccccaggcctggactgtgactttgcagggtgacaaaaggatatgagtctcgagggtccctgctacccacctcctgacatgggctacactccactgaattatttgggctctaagctctgggtgtgcacaggcgctgctccacagtgtccacaggcaggcagcaggcctcccctcccctgcccacagccgtccacgtccctcagcctctacctgaagcacgagtgtccctccttccccaacaggacagtcaccaccacagtgaaatcatttaggcctaagtgcattttacctggaacaaccctaggggaccggccacttcacagacctgcaaacaggcctggagagggaaaagacccacgaagcctcctcagctccatttgggcccagggatgtgagattcggagtccatgctatcttcaccacccagctcttcctctgtctccaatataggaaggtagctgagtccaggcacagccccagtctgccctcctccccagcccagccaggcccccttgcacatacctggttcccaggggtcaggcacagccagcccaggcaattccccatgtgagccgtagaagcaggcttggcgcagtcctcctctccctctcgtctctccggggccctgggctgggctcccctgcccccacccaagcacagggctcgcctctgggcagcctcctgggccatggccccctgggtgcccatatcccggcagctgcccctaaaagccacttaggctgaggcgccgcgactgctcgccaccccaacccctgcaattcctgggtaaggctgcttcaggctcccgcccggccggccgcttccatctctctgtctgcatgtccagaggctgcctgtctggcctgtggctggcctccctggacacagcctggtgctgccacccttggagtctgtgaagatggctgtgggcagtgtgacccaccaccacgcaccccacataccacacctgtttgggcttagggggtcatcccacaccaaccaggtccacccaaaacctggcaggctgtagcttcctggccacactagagtcgagggaggtggctggatgggagactccagcagccccaggtcccctgggtaagggggcttgcagaccttacccgccctgggtggggcagacgcctgatccgttgacctgcaggtcgac

SEQ ID NO: 3999 - DNA, 1590 bp, Homo sapiens
gaattcctttttgcagagaaaggtttgttttattgcaattatttagagcgcgtcccaagggggaggggaagggggaggggaaggggggggtctctggtattaagtggaaacatgtgtggagctggagatctttttggaaaaaaagcaaaaacacaaattcctttcagtcagcaggccccggcagagcagcaaaggccctcgccccgcggctgccgcgcgctcgctcgctctctctctgtctctctctgtgtctctctctctctctctctgtctctgtctctgactctctctcacatctctgggtctctctccccctatcttgctgccacaggcccccagtacctggtgggcaggggcaggatgggggctcaccggggctggggctgatttctgggcaatggcaggaccaccctccagtccactgaggctgggggagctcggggcaggctgaggcccaaggtccgtgcgggaggggtcccagggtcccgagacaggcaggaaggggctcagaagttgctgaagatttcacgcttcctgttccagtccatctgtggcgcgcgcttgttgactcgcatggctcgagccttctccttggcctcggccgccgtggggctcaggtggaggccgctctcctcagtgtccttgtcggaaccaggcaggtcacttcgggacgagcacgcagagccaccattgagctgggtgagctgggcagggctggttccattggtgacgggtgacggcagaggaccttccacgtgctcctcggtgggtgtgacccgaagccgcttgaagtgttcatctgtctcggggtccacgaccagcagccgggcctcgtcctcccgtgccttgatgctggccaccacctcagcatggcgcagtccctccacattctgcccgttcacctcaatgagccggtcctgggcgcggaggccagagcgggcggcaggtgagcccgggtccacagagcggatgtactggccgggccgggacttgtcactatgcaggttgaacccatagccctgaggtccctttcgcaggtggcagagccgagggcgcagctccctcaggggcccactgacatccttcttgccagcttcggagctgtggctgccggtgtgtgcccagtctggcttcggctcccaggggtcgtggggcgggtgggagccctcgctgggccatctcccttcggtacaggtcagctgccgccggcggagctcctcatctgtctcctggtccaccaccagcagccgagtctgcccctccacagccttgatcctttgcaccacctggtggtgcgtctcgccctccacgttgacgccgttgacctcgaccaggcggtccccagcgcgcagcgcggcggcctcggcgggggaaccgggttccacgcgccggatgaactgcccgcggcggcccttctcgccgtgcaggtggaagccgtagccctgctctccgcgcaccaagcggcacaggcgcggccgcagcggctccggcgcggccatggcgcccgctgcccaccggccgcccgcgggcaggggcgcgggggagctcgggggcggcggcggcgctgggcacccggctcgtgccgaattc

SEQ ID NO: 4000 - DNA, 1535 bp, Homo sapiens
gcagagaaaggtttgttttattgcaattatttagagcgcgtcccaagggggaggggaagggggaggggaaggggggggtctctggtattaagtggaaacatgtgtggagctggagatctttttggaaaaaaagcaaaaacacaaattcctttcagtcagcaggcccccagcgcgccccgccagcgcagcgcccgcccgccccccgcggctgccgcgcgctcgctcgctctctctctgtctctctctgtgtctctctctctctctctctgtctctgtctctgactctctctcacatctctgggtctctctccccctatcttgctgccacaggcccccagtacctggtgggcaggggcaggatgggggctcaccggggctggggctgatttctgggcaatggcaggaccaccctccagtccactgaggctgggggagctcggggcaggctgaggcccaaggtccgtgcgggaggggtcccagggtcccgagacaggcaggaaggggctcagaagttgctgaagatttcacgcttcctgttccagtccatctgtggcgcgcgcttgttgactcgcatggctcgagccttctccttggcctcggccgccgtggggctcaggtggaggccgctctcctggaagggatcttgcttccaggcactgccatcctcagtgtccttgtcggaaccaggcaggtcacttcgggacgagcacgcagagccaccattgagctgggcagggctggttccattggtgacgggtgacggcagaggaccttccacgtgctcctcggtgggtgtgacccgaagccgcttgaagtgttcatctgtctcggggtccacgaccagcagccgggcctcgtcctcccgtgccttgatgctggccaccacctcagcatggcgcagtccctccacattctgcccgttcacctcaatgagccggtcctgggcgcggaggccagagcgggcggcaggtgagcccgggtccacagagcggatgtactggccgggccgggacttgtcactatgcaggttgaacccatagccctgaggtccctttcgcaggtggcagagccgagggcgcagctccctcaggggcccactgacatccttcttgccagcttcggagctgtggctgccggtgtgtgcccagtctggcttcggctcccaggggtcgtgggcgggtgggagccctcgctgggccatctcctcggtacaggtcagctgccgccggcggagctcctcatctgtctcctggtccaccaccagcagccgagtctgcccctccacagccttgatcctttgcaccacctggtggtgcgtctcgccctccacgttgacgccgttgacctcgaccaggcggtccccagcgcgcagcgcggcggcctcggcgggggaaccgggttccacgcgccggatgaactgcccgcggcggcccttctcgccgtgcaggtggaagccgtagccctgctctccgcgcaccaagcggcacaggcgcggccgcagcggctccggcgcggccatggcgcccgctgcccac

SEQ ID NO: 4001 - DNA, 577 bp, Homo sapiens
gcagagaaaggtttgttggagggcaattatttagagcgcgtcccaagggggaggggaagggggggggtctctggtattaagtggaaacatgtgtggagctggagatctttttggaaaaaaagcaaaaacacaaattcctttcactcagcttcggagctgtggctgccggtgtgtgcccagtctggcttcggctcccacgggtcctgggcgggtgggagccctccctgggccatctcctcggtacaggtcagctgccgccggcggagctcctcatctgtctcctggtccaccaccagcagccgagtctgcccctccacagccttgatcctttgcaccacctggtggtgcgtctcgccctccacgttgacgccgttgacctcgaccaggcggtccccagcgcgcagcgcggcggcctcggcgggggaaccgggttccacgcgccggatgaactgcccgcggcggcccttctcgcctgcaggtggaatccgtagccatgctctacgcgcaccaagcggaactatgcacgttgaacccatacccctgagtccctctcgaggtggcaaatccgagggcgcac

SEQ ID NO: 4002 - DNA, 761 bp, Homo sapiens
  misc_feature (1)...(761): n = A,T,C or G
attttgaanaacctnaaaatnnaaagncnnaaaattttccngttaccntaaatnaccnggncttnnnnnnaangcaaaacnggcngnaagttaacccngggncaaaaaaccnaatttacttgncnggncnggactttgnacnnatnaaggtttaaccaaanacccttaaggnccctttttnaanggttgaaaaaccnaaaggccnaaagctncccttnaggggccnaatttanaanccttgaaggcccaaacgggaaagggnnaagcctctttgctcaaagcctnnccgccttcaaaaggccaactcccccggttgttcccnncaacttnccnaaaactngggtaccgttgccccccnacggggaagnccccaggttctcaattggcaaacacttccgggcacccaggcttgcctgtnacagagctttagctgtggaaanttggcaaagcctgttttcaaacccagaagcctncccgacgggcccagccgccttcccgggttgctggnagaattcctttggctcgaggccagcgtggcgnanaggcagggtgggaggaagcaccaggtgggatgaactgtcgncgtcggcctcctggggcggttgtccctgaggctctgcctgtgcgtccccctnccccgggctctcctccagancgtggggcagacnctccctagtccagcagttttgttttctctccanacgcctccagtgggnatgccncagtccnaaaccatnatcccggnggnaccacaatgtcaa

SEQ ID NO: 4003 - DNA, 405 bp, Homo sapiens
  misc_feature (1)...(405): n = A,T,C or G
ggccgggcngggaaattgttnaactatgcaggttgaaacccaatagccctgaggtccctttcgcaaggtggcagaagccaagggcgcagctccctcaggggcccnactgacatccttcttgcccagcttcggaagctgtggctgccggtgtgtgcccagtctggcttcggctcccaggggtcgtgggcgggtgggaagccctcgctgggccatctcctcggtacaggtcagcccctccacagccttgatccttntgacaacctggtggtgcgtctcgccctccacgttgacgccgttgacctcgaccaggcggtnccnccagcgcagcgcggcggcctcggcgggggaaccgggttccacgcgccggatgaanctgcccgcggcggcccttctcgccgtgcaggt

SEQ ID NO: 4004 - DNA, 395 bp, Homo sapiens
ttgtggatcccaggcagggcctgtttattctgagagcgcgcatgcgctatggcttacgaggcaacagcggtgccggtcgatcgggcctcgtcctcccgtgccttgatgctggccaccacctcagcatggcgcagtccctccacattctgcccgttcacctcaatgagccggtcctgggcgcggaggccagagcgggcggcaggtgagcccgggtccacagagtggatgtactggccgggccgggacttgtcactatgcaggttgaacccatagccctgaggtccctttcgcaggtggcagagccgagggcgcagctccctcaggggcccactgacatccttcttgccagcttcggagctgtggctgccggtgtgtgcccagtctggcttcggctc

SEQ ID NO: 4005 - DNA, 493 bp, Homo sapiens
tttttgaagagaaaggtttgttttattgcaattatttagagcgcgtcccaagggggaggggaagggggggggtctctggtattaagtggaaacatgtgtggagctggagatctttttggaaaaaaagcaaaaacacaaattcctttcagtcagcaggccccggcagagcagcaaaggccctcgccccgcggcgtgtctctgtctctgactctctctcacatctctgggtctctctccccctatcttgctgccacaggcccccagtacctggtgggcaggggcaggatgggggctcaccggggctggggctgatttctgggcaatggcaggaccaccctccagtccactgaggctgggggagctcggggcaggctgaggaccaaggtccgtgcgggaggggtcccagggtcccgagacaggcaggaagggggctagaagttgctgaagatttcacgcttcctgttccagtccatctgtggcgcgcgctgttgcc

SEQ ID NO: 4006 - DNA, 431 bp, Homo sapiens
  misc_feature (1)...(431): n = A,T,C or G
gcagagaaaggtttgttttattgcaattatttagagcgcgtcccaagggggaggggaaggggggggttctttggttttaaatggccacatttgtggagctggagatctttttggaaaaaaagcaaaaacacaaattcctttcagtcagcaggccccggcagagcagcaaaggccctcgccccgcggctgccgcgcgctcgctcgctctctctctgtctctctctgggtctctctctctctctctctgtctctgtctctaactctctctcacatctctgggtctctctccccctatcttgctgccacaggcccccagtacctgttgggcangggcaggatgggggctcaccggggctggggctgatttctgggcaatggcaggaccacccttcaatccactgaggctgggggagctttgggcatgctttagc

SEQ ID NO: 4007 - DNA, 332 bp, Homo sapiens
  misc_feature (1)...(332): n = A,T,C or G
tgccaccacctcagnatgcggagtccctccacattctnccgtnacctcaatnaccggtcctggacgnagccagaaccggcgcagtnagcccggtccacagagcggattgtactgccggccggacttgtcactatgcaggttgaacccatagncctgaggtccctttcgcanggtgcagancgaggcgcagctcctcaggggcccactgacatcctgtaccagcctctggggtggctccgtggangggctccggagcccgggcaggtggcgtgcactcccggagcgtgccatgacagcggcacagtgacagcaagtggcaggcgtccggccgg

SEQ ID NO: 4008 - DNA, 859 bp, Homo sapiens
tttttttttttttttttttttttttttttttcagagtctgatcttatttatttgttactcaaaaaatcttatttctgactggattcagacttagaagtagaagctcgcagagaggaaagtctgcgtctcttcgcaatttgttcctggcgcttctccttagcctccttcattctcttggccaaaagtttagcatattctgcagcctcttctttatttttcttggtacgctgcttcttcagagcaatacgccgccgtttgtgctgcaggacacgtggagtaacaagacgctgaatcttgggtgctttggtcctaggtttcttaccttctttatttaagggctttcttacaacatactggcggacatcatcttctttagagagattgaaaagtttgcggattctgctagctcttttggggcccaggcggcgaggcactgtagtatcagtcagtccaggaatatccttctctcctttttttacaataaccaagttgagaacgctcagatttgcatccacaatgcaaccacgaactgattttctctttctttctccagttctccttggtctgtaacaggaatgccccttactcagtagcaggcggacacggccatgggtcaagacaccctgcttcatggggaaaccttgtttgtcgttcccaccactgattcggaccacataacccttccattcttcacccagagcgtcagcagcaacttctgtggccatacgcttctcatagaaagtacgaagtttgcgttcatcgtccacttcaatgagtttctggcagccaggggctgggaaagggaaatgttcagcttcatcttaaagcagctggaccgcctccggggcgccaccggaaa

SEQ ID NO: 4009 - DNA, 845 bp, Homo sapiens
  misc_feature (1)...(845): n = A,T,C or G
agcggccgcccttttttttttttttttttttttttttcagagtctgatcttatttatttgttactcaaaaaatcttatttctgactggattcagacttagaagtagaagctcgcagagaggaaagtctgcgtctcttcgcaatttgttcctggcgcttctccttagcctccttcattctcttggccaaaagtttagcatattctgcagcctcttctttatttttcttggtacgctgcttcttcagagcaatacgccgccgtttgtgctgcaggacacgtggagtaacaagacgctgaatcttgggtgctttggtcctaggtttcttaccttctttatttaagggctttcttacaacatactggcggacatcatcttctttagagagattgaaaagtttgcggattctgctagctcttttggggcccaggcggcgaggcactgtagtatcagtcagtccaggaatatccttctctcctttttttacaataaccaagttgagaacgctcagatttgcatccacaatgcaaccacgaactgattttctctttctttctcagttctccttggtctgtaacaggaatgccccttactcagtagcaggcggacacggccatggtcaagacaccctgcttcatggggaaacctttgttgcgttcccaccactgattcggcccacataacccttccattcttcaccccagagcgtagcagcaaactcttgtgccatacgcttcctccatgaaggggtcgagggttgcgtctcggccacttttcatgagtnctggcagcccggtgcgcttggggaaagaagttactcatcttgagcagctgaaacgcttcgagg

SEQ ID NO: 4010 - DNA, 747 bp, Homo sapiens
  misc_feature (1)...(747): n = A,T,C or G
tttttttttttttttttttgtcagagtctgatcttatttatttgttactcaaaaaatcttatttctgactggattcagacttagaagtagaagctcgcaggaggaaagtctgcgtctcttcgcaatttgttcctggcgcttctccttagcctccttcattctcttggccaaaagtttagcatattctgcagcctcttctttatttttcttggtacgctgcttcttcagagcaatacgccgccgtttgtgcttctttatttaagggctttcttacaacatactggcggacatcatcttctttagagagattgaaaagtttgcggattctgctagctcttttggggcccaggcggcgaggcactgtagtatcagtcagtccaggaatatccttctctcctttttttacaataaccaagttgagaacgctcagatttgcatccacaatgcaaccacgaactgattttctctttctttctccagttctccttggtctgtaacaggaatgccccttactcagtagcaggcggacacggccatgggtcaagacaccctgcttcatggggaaaccttgtttgtcgttccancactgattcggaccacataaccctttcattcttcacccagagcgtccagncaaacttctgtgggccatacgcctctcatagaaagtacggagtttggcgttcatcgtccaacttccatgagtttctgggaaccagttgcggggaaaggagatgttcagcttca

SEQ ID NO: 4011 - DNA, 711 bp, Homo sapiens
tcctattcatttgttactcccaaaatcttatttctgactggattcagacttagaagtagaagctcgcacgaaggaaagtctgcgtctcttcgcaatttgttcctggcgcttctccttagcctccttcattctcttggccaaaagtttagcatattctgcagcctcttctttatttttcttggtacgctgcttcttcagagcaatacgccgccgtttgtgctgcaggacacgtggagtaacaagacgctgaatcttgggtggccttggtcctagggtttcttaccttctttaattaagggctttcttacaacatactgggggacatcatcttctttagagagattgaaaagtttgcggattctgctagctcttttggggcccaggcggcgaggcactgtagtatcagtcagtccaggaatatccttctctcctttttttacaataaccaagttgagaacgctcagatttgcatccacaatgcaaccacgaaatggttttactccttctgttccccagttctccttggtctgtaaaggaatggccccttatcagtagcagggggacacggcatgggtaaagaaccctgtttatggggaaacctgtttgtcgttcccaacatggttcggacaaataaccctccaattttcacccaagtgtcgaggcaactttcgggggcaaaagctctcatagaaagtacgaattagggttcat

SEQ ID NO: 4012 - DNA, 875 bp, Homo sapiens
  misc_feature (1)...(875): n = A,T,C or G
atattaattcattgtattgtactttataaaagcatcagttcatgacgaattcggaacaaaattaggccttcaccatagatagtctgagaggcacagctccaaataattcagagtatgtaagtatgcagaggtgcatttttcccccttaaaaagaacaaaggacagggtgaggaagctcacacttgtgatcctaacacttcggaaggccaaggctggaggatcacttgagcccaagggttcaagaccagcctgggcaacatagcaagaccctgtctcaaaaaaaagaaaaaaaaatgtaaattaacagtaaagtttttcaaaaatcatttagccttcagaatatgattctcattcaagattgaaagaactactgttcattgggtttatctgtttcaggcactgaggttggccttccaaatgcatgggctcactcaattctcagcaaccccaacaaggtgagaattagcactgtgttccagatgagaagactgatccctggaaaagctacatcaccagccaaggactttgcagcttaggaggtggactgtgaaacagactatccaactgtaaagccaggactctccaatgtaacttcaaaatctactcaattatgaataaaaaggtgtaatggtttaatctcacagacaaacaaggcattccctatcatccctaccgtgttctagagatgtagtcaaattgactagaaaaatcaattcccacacagcttcagaaatcaaaagctgacagtttatcagatatacatactctacacacacacaaacacaaacatgcacacgcacacgaatagaggaatgaagtaatgaacaattacaactttggtggcaagaatttatctctgattttnaaaagactgc

SEQ ID NO: 4013 - DNA, 1226 bp, Homo sapiens
tttttttttttcttccttttcagagctggctcctcgatgactggctgctctaccttctttttggacttcatctttttctttgcggaggccttagggtcatcacttatggggatgtattccggagcctcaactttgactggcttctttttacttcctttcctagggctgctctccatggacctggagggcttggagtggcctgggagggcatctccctcctggtggattttttttttcttcttcaccttcccattgtgttctctggggctcttccgcttccgtttctgccccaaggctgcctgttcctcatccttcttccccactgagcaagtgtccccaacatccctggcctccctggcctcacagaaccaagggtcctggaccgagaaggctgtggggtcctgggccccctttttttccttcttgtgttttttgagcttcttgccaactctggtttcctcctcaccctgtctagggtctggggaggttttcaccccagaggcatgggacatggctagaggtgacttcttatttttcttttccccactgaggaactccaagtggccaaacacctgcttcctgaggctgggtgacttctctgtccgtctagcaggcagcgtggtctcaggttctacatgctcctcgcaaagggtgctgacacccttctttttcttcttctttttcttcactagaggcatctcaggtgcctgcccatgggccacactcttagagggggatgtagctcttaaaggagaaacatcagcaaagtaatcatcattgtttaaaactgagtatcgagtctctggttctttgaccactttcttcttctttttcttctctgggagcccaaggtctactttgtgtgtcttggtgatcattcctgaaaaaacaaatggtacaagttatcccataccaagccatcctgtgttcaattctactaagcattgccaagagccatgtttctttgagtgggtggtcaaagcgttgtgggacagggaaaatggacatgattcctttaaagcaaaaaaagaaatactacagaaacagcgtaaattttaaatccacacagccctaggttcaaacctaaatgcctctctcaccttaagtaaatcagctaacctccctgagcctcaatttctccatctggaaaatgggggaatataacacctccctcctcaaaagggtgttggggggagtaaatgagataacccatggaaagggcttgg

SEQ ID NO: 4014 - DNA, 1293 bp, Homo sapiens
tttttttttttttttttttttagtggctgggtgaccccaggcaattttattactttatccctgaacctcagttgcctcatctataagatggggctaataatagcacccatttcataattatgaagattaaatacattaaggaaaacactagtatgtccctagtacctgctaaacactcaacaaaagttaactgtacatactgatgtctcaaacagggacggaatgtttaacacagaaaacaggaggttttagcactcactcgttctcctggctcccgaaatatgagctgccctgccccagttcatccaagcccatcaatatagttgtcctcgtccttaatctccacaggtgttcaatgtgagccaactgtcagatggctttcatttgcacaactgaataaaccatttatgcctagtgttccattactggaacgctaagcttatgggagttatttatatcttactgctcgaggtcctcaccaagatctgattttttccacaaaaaaaatttgtaatctccagcataaatggaataatcaaagcaattgtggccacgttttggggggacaaaactctagagtttaatcttccagcttgactgacttggaagcgttcctgtcaatgtaaaagatcttgttgggggcggtggagaagccgaggccggctccccggctgtacttccagctcatggcccggtcgtagtcccgctgcagattctgctgcagctgtcagccgccttcttgccgagggccatgttgggccttgcaatcgtgctggcggggcggctgaacgaaggggacaggttttacatgctcctcgcaaagggtgctgacaccccttctttttcttcttctttttcttcactagaggcatctcaggtgcctgcccatgggccacactcttagagggggatgtagctcttaaaggagaaacatcagcaaagtaatcatcattgtttaaaactgagtatcgagtctctggttctttgaccactttcttcttctttttcttctctgggagcccaaggtctactttgtgtgtcttggtgatcattccttgaaatagtgtagtcaggagagccaagacgacttcagaataggggagtagtcaagagagccaagacgacttcagaataggggagcagtcaagagagccaagacgacttcagaataggggagtggccaagagatctggtaagaacaaagaatccaccgggaggttgcgggtcaactcttaatccccttctctccccatctcttgccatttagaaaagtatagcatcctcctctttagc

SEQ ID NO: 4015 - DNA, 536 bp, Homo sapiens
cttccttttttatttggctcctcgatgactggctgctctaccttctttttggacttcatctttttctttgcggaggccttagggtcatcacttatggggatgtattccggagcctcaactttgactggcttctttttacttcctttcctagggctgctctccatggacctggagggcttggagtggcctgggagggcatctccctcctggtggattttttttttcttcttcaccttcccattgagttctctggggctcttccgcttccgtttctgactggcagctttggtagtttgaggacacatctgaaagaggtgagctgaagcctttcagttttcagctgtacttgcattaaagcaaggcttgtccctgctggggtacccttcattcctcgacctcactgactggtgagtttcttccatttcatgagtaatgaccatctgtgggcacagagcttcgtcatcttactgaatccccgccctttgcaggggtgaccttactgtcacttacagatgaagcagctgggactttgggag

SEQ ID NO: 4016 - DNA, 457 bp, Homo sapiens
  misc_feature (1)...(457): n = A,T,C or G
ttttttttagtgggctgggtgaccccaggcaattttattactttatccctgaacctcagttgcctcatctataagatggggctaataatagcacccatttcataattatgaagattaaatacattaaggaaaacactagtatgtccctagtacctgctaaacactcaacaaaagttaactgtacatactgatgtctcaaacagggacggaatgtttaacacagaaaacaggaggttttagcactcactcgttctcctggctcccgaaatatggagcttgccctgccccagttcatccaagcccatcaatatagttgtcctcgtccttaatctccacaggtgttcaatgtgagccaactgtcagatggctttcatttgcacaactaaataactcccataagcttagcgttccagtaatggaacactaggcataaatggcttattcagttgngcctagt

SEQ ID NO: 4017 - DNA, 344 bp, Homo sapiens
tgagacaaaggttcaggcagcttatctcaccgggccagctctctaggagggaggcaagcgcccttttcagaaggaaggaaattagctcaggacaaattctgctgtggagggagcctgctgcaggctagggctgcctctggggcctggacgtacttggttctcctgctccactcttcatgctggaggcgaggggaagcgtcgggaggccgagcgtgccacctccttgcagagccctagccccaaacttaccgtccacttcctggtttcagaagcttccgttttgcctgacttgcgatcgatctcttcttgcaaggcctttcgcctcacctggtctatgtgcgcct

SEQ ID NO: 4018 - DNA, 454 bp, Homo sapiens
  misc_feature (1)...(454): n = A,T,C or G
ttgtgggggcggtgaanaaaccaagccggctccccggctgtactncaagctcatggcccggtcgtagtcccgctgnagattctgctgcaggctgtcagccgccttcttgccgagggccatgttgggccttgcaatcgtgctggcggggcggctgaacgaaggggacaggtttttgaagccacccataagtctgagaaatttcagtttttggtcctcgttctnaaaaccagcagtatcccactggccaaactgggttcccgtccacttcctggtttcagaagcttccgttttgcctgactcgcgatcgatctcttcttgcaaggcctttcgcctcacctggtctatgtgcgcctcatccatgttgccttttttttccaacaccacctctaagtccgtgtctgtttcctccntcnaagggtctcctgctaccccactctctttcctcttcttcctc

SEQ ID NO: 4019 - DNA, 299 bp, Homo sapiens
  misc_feature (1)...(299): n = A,T,C or G
ttattgccgagggccatgtnggggcnttgcaatcgtgctggcggggcggctgaangaaggggacaggtttttgaagccacccataagtatgagaaatttcagtttntggtcntcgttntcaaaaccagcagtatcccantggccaaantgggttccctgtgaggagaggaaaaaggtggctattttccttgagttcaaagccctttccttcccttgacccccaccctcatcagggagggcccagcagattagatggctgctgtgtaccaggcacagtgctaataagctcaacaacgcgg

SEQ ID NO: 4020 - DNA, 736 bp, Homo sapiens
gacacacctgttactcagcctcaggacatcctgatgacacgtgcccaaggtggtcgggcatagcttggttttatacattttagggagacatgagacatcaatcaatataagaagtacattgattcggtctggaaaggtggggcagcttgaagcaaaggcaggaagcctccaagcagggagggaacttccaggtcgcagataggtgagagacaaacggttgcattcttttgagtttctgattagtctttccaatggaggcaatcagatatgcatctatcttaatgagcagagggataactttgaatagaatgggaagcaggtttgccctaagcagttcccagcttgagttttccttagtgattttgggggcccaagatattttcctttcacaggtgtgacccgacactcctggcctacatccttgactgaaagaagtgctgcatcacggaacaaacgctaaggtgattattaggtctctcaccctctccttttctcattcttactctttctctctcactttcactctagctttccctctctctgcctctctcccattccctccactggacccttgaacttagggataagctgttaatagtcccctactattgtacctgtatttctctacaagttgcctagctagatctttgggaaaagtcccttcggttttttttgtttttgttttttttttgtgacagagtgagaccctgtctcaaaatatatatatatgaaactg

SEQ ID NO: 4021 - DNA, 836 bp, Homo sapiens
  misc_feature (1)...(836): n = A,T,C or G
ttgattccccttcaggcaaagtgagtggttcccttctctatgttcctgcaacatttttttcctatctcagtcatagtttttgtaacattatgttgtaattttctctctctgtcttcctccatcatactgggaacttctggagggcagcacttcttgtgattcatcactgtgtcctctgtacccggcaacaacacagcatagggccagacacgtagtgtctgccttactcatttattgaatgctctgctaattgtcaggtgcgctgctaaaaattttggaggcattaattcaccttctaaggttggtactattatcccttttgtctttttttttttttttttttttgagacaggatctcgctctgtcacccaggtgggattgccgtggacgatgacagctcactgaagcctagaccttctaggctcaagtgatcctcccacctcaccctctcagagtgttgggattactggcatgagccactgtgcccagctgttatcccttttcacagatgaagagactgaggctcagaaagatggaataacttgctcagttacacatagctaggaagtagggagctggaattttgtgtatttttttttgtttgtttgtttgagatggaatcgctctctgttgccaggctggagtgcagtggcgccatcttggctcaacggcgatctctgccctccccggattcaagcgattctcctgcctcaaacctcctgaagtaactngggactaanagttgtgcgccaacaaaacccagtaaattttggaanttttaagtagagacganttttcaaccatgttggccaagatgggtttgaaccccttaaacc

SEQ ID NO: 4022 - DNA, 2588 bp, Homo sapiens
aatgggcccaagaattactccaaacatgaggagttaactgtgagcccagctcctgctgtgcctaagggaagggaatcagaagttggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaaaaaaaaaaaaaaaaaaaaaaaaaaaaaaaaaaaaaaaactcgagggggggcccggtacccaattgccctatagtgagtcgtatta

SEQ ID NO: 4023 - DNA, 706 bp, Homo sapiens
  misc_feature (1)...(706): n = A,T,C or G
gagangcggacaaggagcgccacgtatgnctgtttgagcatcttacaacgatcgcagtgtttctcaattaacacgatctgtggagctaagcggtatgtgtagtntatgcagccacataatttacccaagctctcacataggcagntagcctttacttaatatcaagacaagtgaaaaaatattggcatcgatgaaaccgataacatggccctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaa

SEQ ID NO: 4024 - DNA, 529 bp, Homo sapiens
  misc_feature (1)...(529): n = A,T,C or G
cgaaaccagggccccagggaccctaccccaccacagggcaagaagtacccncagccnccaggaaccggcaggccgnggcctgtacagtngataataaattccaaaaagaacagcgcccaattccnccctnggttaggttatacctccataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcatttaagaaaaaattaaaagatctcttttgtttaaaaaaaaa

SEQ ID NO: 4025 - DNA, 389 bp, Homo sapiens
ggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtggggatttgccttgtttgtaagtctacaatttgcccagggttaattaccattggcccgcctttaaagttaaccggtgtttttttgcttggggttcctaagccttttaggaaaaaattaaaagatcttttttgtt

SEQ ID NO: 4026 - DNA, 293 bp, Homo sapiens
ttgaatacgaagttgaactgatgttaaaactcgccatctgttcttcaagtgaaacaaacacaactgcctgcaaaatggaactaatggaattatcatacttattcccaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaaaaaaaaa

SEQ ID NO: 4027 - DNA, 513 bp, Homo sapiens
  misc_feature (1)...(513): n = A,T,C or G
tgcggcttccggaccacaagtactgctgcgacgacccgcacagcttcttcccctacgagcacagctacatgtggtggctcagcattggcgctctcataggcctgtccgtagcagcagtggttcttctcgccttcattgttaccgcctgtgtgctctgctacctgttcatcagctctaagccccacacaaagttggacctgggcttgagcttacagacagcaggtggttcctaacttcctggcaacaaccacaattgtaattcgttcaaagagattgactgctgtggagacagatcatcaccatcaccatcaccatcaccatcaccaccaccaccatcatcatcattggtcatcgtcatcattatgttgcttttagctcactggagcctcacagaaccctgtgaggtaggtattacctcagtttaccaaatgagaaaactggggctcggaaggggtttcatggctgtccagacttacaaagcaagtcagaaccagaatcatatctaaatcttcn

SEQ ID NO: 4028 - DNA, 454 bp, Homo sapiens
gctctcagtgcataatgtggtgtattgttaataaatacatgttaaacaaatgatgcttctaaggctctgaccacagtgccactgcccaaggtaagcaccagagaagtcagctggggagtgtgatcctgttggggaagaagagagccacacaccctcagtttgctgttttccaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataaacattcaataaatgtctccataccaaaaaa

SEQ ID NO: 4029 - DNA, 380 bp, Homo sapiens
ttcttctcgccttcattgttaccgcctgtgtgctctgctacctgttcatcagctctaagccccacacaaagttggacctgggcttgagcttacagacagcaggccctgaggaggtttctcctgactgccaaggtgtgaacacaggcatggcggcagaagtgccaaaagtgagccctctccagcagagttactcctgcttgaacccgcagctggagagcaatgaggggcaggctgtgaactccaaacgcctcctccatcattgcttcatggccacagtgaccaccagtgacattccaggcagccctgaggaagcctctgtacccaaccctgacctatgtggaccagtcccataaacattcaataaatgtcaccaaaccaaa

SEQ ID NO: 4030 - DNA, 361 bp, Homo sapiens
  misc_feature (1)...(361): n = A,T,C or G
cccnttcgtaagggtgcacanaacggaacaaaaatcttntcaaaacttgggaccaaggaaacttggggttttaaatcatcatcagcacctcactgtcttcctcgatcttccctttccactcatagatggatgtaatctgagggatgaggttgacgcaggctgctaggcgcttctccaccacggccctggcgatctccttggcgaccttctcgttggggcaagtaacaaaggctgcagagaccgagcaacaaaaggcgggaggccacaggcagcagcgccggcatccaaacaaaagacaggagcagagaggcctgagagcaggaggcgaattcgatctctcctnacaaacagcccaggaaat

SEQ ID NO: 4031 - DNA, 455 bp, Homo sapiens
tgacccaaagacgggatttattgggggcccagtcatcacctggaagtcagaaggcgttgaagtatcgcggggatcttcatgatgagcaggaacagggctcatcatggcaggactgtgatagagtcagaaactgactctgtgacctggcgcacccactgcaggtacggaaagttcccatgttccacaggcaatgcaattacctcggccacttcgtaagggtgcacagaacatcagcacctcactgtcttcctcgatcttccctttccactcatagatggatgtaatctgagggatgaggttgacgcaggctgctaggcgcttctccaccacggccctggcgatctccttggcgaccttctcgttggggcaagtaacaaaggctgcagagaccgagcccggaacgtagccagagccggaatccgaggccggcgagggcatgggtcggagggcttccc

SEQ ID NO: 4032 - DNA, 1765 bp, Homo sapiens
aaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcctgcagctcaagggaggcgtgctcctctcccagagcaggctggaacccagctgggttccgcctcccgggaaggtggtctccattcgtcgctctgcatctggtttgtcagatccgagaggctctgaaactgcggcggccaccggacgcttctggagcaggtagcagcatgcagccgcctccaagtctgtgcggacgcgccctggttgcgctggttcttgcctgcggcctgtcgcggatctggggagaggagagaggcttcccgcccgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaaaaaaaaaa

SEQ ID NO: 4033 - DNA, 377 bp, Homo sapiens
attcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggctctgaaactgcggagcggccaccggacgccttctggagcaggtagcagca

SEQ ID NO: 4034 - DNA, 539 bp, Homo sapiens
ttaatcatagaagttaaagacttaaaacaaactttggcaattaaggcagtataccaagatgcaaatgcctggttggaatggatcaaatattctttccgcacattaaacaaaagcaatcgttatgcttgtgcacatggcaggccagaggcccagattgtccccttttcactaaggtagtcatccagttgaccaggtgtgggctgcatgatagctctttttcaggattctacagcctgggagtaataagttcgtgccaagctctctccgctatgtcctgaagtctggcaccctgcgagtcagcccctgagggccatccagcttccatctcccaacacttaagttcactttcatgtcttcttaacaacagggggaggaaaactttaggcatttcctttggggaggaccttggaaggggatggcagtggaggcttttaaggattttttccaaggagctttatccaatccagttcagccctttgtttccatccccgaggcggatgttgttttgggtatttttgggtggacctttactgggcact

SEQ ID NO: 4035 - DNA, 366 bp, Homo sapiens
ccagagcagcgtgtagcagttccctgtggaggattaacacagtggctgaacaccgggaaggaactggcacttggagtccggacatctgaaacttgagaacatcaccaccctgaagccagagactaacactgcaggactcagcaggactatttaagaaacaactgaggcatcagaccaactttccccacaagtcctcggatctttcttgccatgctgatgccatatattccaacgtgatcaacctggctccccagaaggaggacgactttgctgtctacaccaacatgcccccttttcatcaccccaggaggacattgccagaccaagtgggaatatgtctccattgtattccactgatggggaagc

SEQ ID NO: 4036 - DNA, 814 bp, Homo sapiens
cctttttacctggggggttttttttggcatgtgtgtggcgcgggtgtggtgttttgtctcgaagaagcatgggtcaggtacaaataagcccaccccactaggaactatgttaaaaaaaaattcaagaaagaatttaagggatgattacagtgttactgtgacacccgggaaaacttagaactttgtgtgaaaataagactggccagcattagaggtgggttggccatctgaaggaagcctgggacaggtcccttgtttcaaaggtatggcacaaggtaacctgtaagccaaggcacccagaccagtttccatacatagacagttacagctggttttagaccccctttcccccaccacagtagttaagagaacagccagcataagcggctggcagaggcagcagagagaaaaggaaagaccagcagagagaaaaaaaagaccatctataccaattctaggttaatttagactaaacaaggtcttattaatagcaaaggataattgaaatcccaaacttacaaggttttcaacaaaagtgaagtttgctaaaagttaaaagtgtagcatgtattatggtaacttctaatcttgtggccttagacagtctagtccaaagacataaagaaaattcgcttttttaaaaaggaaagaaaaggggggaggcagaatttatattaaaaaaaagttatatggtaaattcttgtcctgaaataaattaactggttgtttaaagaaaaaaaagtttgttaataagtcaaaaaattgagacatgttaaaaaattgtctgggaaagtcgtgaaaaaaaaaaaaaaaa

SEQ ID NO: 4037 - DNA, 639 bp, Homo sapiens
gtcagctcttgccaaaacggtgacgcaggggtgtgttacctgccgacagcataaagcgaggcaaggtctagctgttcccccccggcatacaagcttatgggagcagcccccttttgaagatcttccaggtggacttcacagagatgtcaaagtgtggaggtgtttcgagtgtggatcaagaactgggaacgtagcctctttgtgtccactgtgggaaagggcccccagactgtcgttctgagcactcccaccgctgtgaagggtagagggaatcccagccctggatccacccacagccatgtaaaacctgcagcacctgaaacctagaaggcaagaccaagcctggacaacccttgcagagtgaccctgaagaagacgacaagccctgctccagtcacacccggaagctgactggtccacgcacggccgaagcctgaggaagctcatcatgagattcatttttcttaaattttggacttgtacaagtaaaggacttcaactgaccttactcaaactggggactgttcccagtgtattcatcaggtcaccgaagttaggacagcaaattaaaacaatctttctgttctatagttattatgaatgtatggaaacaataaaagaaacttgtttgtataatga

SEQ ID NO: 4038 - DNA, 2931 bp, Homo sapiens
acatggtgcgtgataacttgcccttgatttgggttcatttgaagagcgtagaactctaacaaataaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcctgcagctcaagggaggcgtgctcctctcccagagcaggctggaacccagctgggttccgcctcccgggaaggtggtctccattcgtcgctctgcatctggtttgtcagatccgagaggtaaacattcgggcttggtgttgaattaaaatcattgattgaaccttattctggggcttcggtttggcttactagtttgggattttaaaaaaataaaaattaagcctatagagagggcaaattaaaattaggttgggtaaaggaaggagcgcgagtgtttgaagccgtttggagggaacagcggtttccaagttcctgctgacttgagaagtctctgcgggtttccgaatctccggcgcactcctgggcgcgctgcgggagctgtagctcagccagccagggagtagcggctttcatccgccgggaggagtctttcgagttcaatcgcggggtatagaggttcccctgcggggcaaaatgcagagcttgacacaagcccttggcctctaggtgccttaattccgcggttcccacgcacgcttaactaagacgtgtctgtattcctcccgttacgtgaaagagttcggagctttgcctgggacccccatcattccctccctggcacaccccttccagaacgccccgccccactgcatattatttacccctcctggccacgcgggggaagaaaaacagctgagagggcatcaggaaggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgaccccaaagtgtctgtcttccttcctctgcttgtctctaggctctgaaactgcggagcggccaccggacgccttctggagcaggtagcagcatgcagccgcctccaagtctgtgcggaccggccctggttgcgctggttcttgcctgcggcctgtcgcggatctggggagaggagagaggcttcccgcctgacagggccactccgcttttgcaaacccgcagagataatgacgccacccactaagaccttatggcccaagggttccaacgccagtctggccgagtgcgttggcacctgcggaggtctgagagaggagacaggacggcaaagatctccgcaacggcaccatctcccctcccccggtgcaaaggacccatccgagatcaaggagactttcaattacatcacaagggtggggtcatgcctggtgttcgtgctgggaataatcgggaactccacacttctggagaattatctacaggaacaattgaatgcgaaacgggtccaatatcttgatcgcaagcttggcttctgggagacctgctgcacatcgtcattgacatccctatcaatgtctacaagctgctgggcagagggactgggccatttgggagcttgaggtgtgttaagctgggtgccttttcatacagaaagcctccgtgggggaattcactgtggcttgagtcttgtgtctagtattgacagatatcgaggctgttgcttcttggagtagaattaaaggaattggggttccaaaatggacagcagtagaaattgttttgatttgggtggtctctgtggttctggctgtccctgaagccataggttttgatataattacgatggactacaaagggaagttatctgcgaatctgcttgcttcatcccgttcagaagacagccttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgaatcacctaaagcagagacgggaagtggcccaaaaccgtcttttgcctggtccttgtctttgcccctctgctggcttccccttcacctcagcaggattctgaagctcactctttataatcagaatgatctccaatagatgtgaactttttagctttctgttggtattgggactatattggtatcaacatggcttcactgaattcctgcattaaccccaattgctctgtattgggtgggcaaaagtttcaaaaactgctttaagtcatgctttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctca

SEQ ID NO: 4039 - DNA, 5948 bp, Homo sapiens
tttttttttccttagacgctggtaatttatatttattgaccatttcttgttcttgtcagactcaaatccaggtctctctgacccagaggcagagctcacaatcagttctctccactagttgccttgattgttcaaggtaaataatggacacttagccacttgtctgtgtgaagtgctcttttcgagtgttctttggtcctgagggaccctgaggagcaactctctcacaggggagggcttctgaacaatggtttctgacctggaaacagaccagctgcagcttctgaaaccgggattaaagtctcctaaactccccccgttttgaacaagaagtttgggggatgcaaagcagagtgagaatgaagctttttacaaaaagtaaatccttttgaaaagacatttacaaatgtgatgagaaaccaaagagaaagcccatatcaaactctgttaacatttgatggtacatttcaaaacatcttcttagtccaagagactcagaaaggtagaaataaataaatcacatagagtatgcttttaaacatcatattttaggcaggtaaaaatatctcactttgacagatcatgcaaagaggaacacaaaatacaaaacatcagcttgtacaggcactccatgtgctatacatattgtggtttagcaccaagctttaaaatataaatcacaaccagattgcaacataaacaccaagtaaaactacatgttcctatgtctttactagtttttgcttaccaggtatggctatgaaagattacaatgactttttgacaaacacaacagaactcacagataaaaatgcacttggttccttcaaagcgtccccttccgtaggtgcacgggaactccatgtcagctgttcgtctactcaaacatatcattttgagctgccaccactcttgggaataccgtgtatgtgtatctgtgcacacttaagagggcacattgttaaaatattgtatttttttttttgagacagagtcttgctctgttgcccaggctggagtgcagtggcgtgatcttggctcacggcaacctccacctcccgggttcaagcgattctcgtgcctcggcctcccaagtaagtgggactacaggcatgccccaccatgcccagataatttttgtgtttttagtagagacaaggtttctccatattggccagactggtcttgaactcctggcctcaaatgatctgcccacctcagcctctcaacatgctgggattataggcttgagctaccatgcccggccaaaagggcacatttttgcctttcggagaaaatatgctacaataagctgaaaccccagaggatctgtactctaactttctcacataactagctatgtgaccttgggtacctctctcaccttgctgaacctcaatttgctcctctgcaaactagagttagaaaattaccctcctgtggggtgttgtggggcttaaatgagataaacctagtacagccctcaaaaatatggcattctgcccccattccttcttttaatttttaacgtgcaaccattcaaaaatatttcatttctctttcttttgaggatgccttttgccaccacttttttaatagccaaaggaaatttggggttaaagatgatgggtgtgcaagctgcataattttctatccactctaaacatgtttgagtaagaaataataaggcagaatttccagggtggttcagacactggttctggagaaagctgttaaagaggctcagaagagaagttttctgagaagggatagcccctgtggaacagctgtcatgcctctcaaggtgacccctggaaggggacagcaactattggcatggataaagtctctgcacagttatacagctccattccaggagggctcaagagtccttttcaattctccagtggaaccctagccacgtgtctcttcagttgtcaatcacttgactcggaaagcttgaattacaatgagtctgaggctcccatagttcctgaggagcaggagagttccacccaggtctgattctctctctcttttatttttattatttttttctttttgaacccagttacaagaaacaggtctgactttcttgcaaagattctgcttcctcctcaaagttcaatctctctgctgatcaccgccatctgctgttcttctatggtgcctaagaactttccaaactaccaagcccctaagactgtggtttggattccagaaagcccaggtgcctgcctggcaacacacaggccttcgtcctctatttccttgttggacatcataaggatcattttgttgcatcccctcagagcctcccttaggagcgaatatgcagaattctcttgaatgtcttcttgaagttctcattgcacaaggggtagatgagggggttcagtgtggagttgatgtagcccagccagatggtgaacatgtgcaaatgttcattgcaacagttcttgcagaaggcaatgaccatgaagaagatgaaataagggatccagcagaggatgaaggctgccatgataaaacccaactgtttggcggccttcctttcgcggttcatgtgcaacccagatacatactgtcttgaatgcgagcggagcctcttccaagtaaacttgatgtaatccaggcctgtgttagacccactcctcaatttgcctttgcctggtgctgtctctgtggtggtatctgagtccgttcgagagaaggattggctatcacctaacatctgatcctctgatatctcgctggccccatgtgtgttcaggccctgctcatctgtcttgagctggccatggctccggttgacggctacatagtccctgctactcccctctgccgcagcctgcatgtgcacaatatcaagtggaaagcagtagagtttgtctacttctctatcatcctcttggctgaagacaactggggatttcatctccttgggggtttgggatggtgacttcaagacagatccaccaccagcatcttttggcttccttttcagaacctcccagggagactccttccctggtttcttggcatcccccttggggttctctggcctcagcttaatttctgagaaggaagggagggacctattgatgagctcccggtgctggcagtgttgtcgtacggccttgtagatcttggcatagaaccagagcatgagcaaggtgggcaggtagaagttgatgatggcagtcatgaccttgaaccaggtgacatcatagaagtctgtctcacacttgtcctctcggcgcaccgaggtctgctgcatgaagtgattccagcctagaatgggaataacccacagaaaagagagaaaccaggcccccagaatggtggccgaggctcgggtcttggtacgatacttaaggtacctgaggggctgctggacagagcggtagcgatcaatgcacaggatgaagacactgaaaatggacgctgtgctggccacatagtccatggaaagccaaaagaggcagagaggacggcccagtgaccacttggacatgagcaggtagaggatgttcataggcatgacgacggcacccacgatcaagtccgccaccgagaggctgacgatgtacaggttccccacagtgtggagcttccgctcactccgtacggcatacagcaccagcaggttgagccctactgtgaccaagcagatagtgctcaggaccaccaccaggggcatcagctgggggctggccatagtggtcttgttgccctcacacatcttgtcttctaagaggcaggaggaattggggaggctcattggcgcaagagcagccgccagttatggctcactccctgggagaaaagagagaaaaagtaaggtcagagacttgggtgatgagtggccacttagtagcatgatgttcatcagactggagttgtatgctgttgggggtgatcaagtggacttcatccctgggatgcaaggctggttcaatatatgcaaatcaataaatgtaatccagcatgtaaacagaaccaaagacaaaaaccacatgattatctcaatagatgcagaaaaggcctttgacaaaattcaacaacccttcatgctaaaaactctcaataaattaggtattcatgggacgtatctcaaaataataagagctatctatgacaaacccacagccagtatcatactgaatgggcaaaaactgcaagcattccctttgaaaactggcacaagacagggatgccctctctcaccactcctattcaacatagtgttggaagttctggccagggcaattaggcaggagaaggaaataaagggtactcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattctaatacaccaataacagacaaacagagagccaaatcatgagtgaactcccattcacaattgcttcaaagagaataaaatacctaggaatccaacttacaagggatgtgaaggacctcttcgaggagaactacaaaccactgctcaaggaaataaaagaggatacaaacaaatggaagaacattccatgctcatgggtaggaagaatcaatatcttgaaaatggccatactgcccaaggtaattgatagattcaatgccatccccatcaagctaccaatgactttcttcacagaattggaaaaaactactttaaagttcatatggaaccaaaaagagcccacatcgccaagtcaatcctaagccaaaagaacaaagctggaggcatcatgctacctgacttcaaactatactacaaggccacagtaaccaaaacagcatggtactggtaccaaaacagagatatagatcaatggaacagaacagagccctcagaaatagcattgcatatctacaactatctgatctttgacaaacctgagaaaagcaatggggaaaggattctctatttaataaaaagtgctgggaaaactggctagccatatgtagaaagctgaaactggatcccttccttacaccttatacaaaaattaattcaagatggattaaagacttaaacattagacctaaaaccataaaacccccagaagaaatcctaggcattaccattcaggacataggcatgggcaaggacttcatgtctaaaacaccaaaaacaatggcaacaaaagccaaaattgacaaatgggatctaattaaactaaagattttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacatccccatcaaaaagtgggcgaaggacatgaacagacacttctcaaaagaagacatttatgcatccaaaaaacacatgaaaaaatgctcaccatcactggccatcagagaaatgcaaatcaaaaccacaatgagataccatctcacaccagttagaatagcaatcattaaaaagtcaggaaacaacagatgctggagaggaagtggagaaataggaacatttttacacttttggtgggactgtaaactagttcaaccattgtggaagtcggtgtggcgattcctcagggatgtagaactagaaataccatttgacccagccatcccattactgggtatatacccaaaggactataaatcttgctgctataaagacacatgcacacatatgtttattgaggcactattcacagtagcaaagacttggaaccaacccaactgtccaacaatgatagactggattaagaaaatgtggcacatatacaccatggaatactatgcagccataaaaaatgatgagctc

SEQ ID NO: 4040 - DNA, 1995 bp, Homo sapiens
  misc_feature (1)...(1995): n = A,T,C or G
gattttgctgtccacaaatacttgtttcagagttttcatggatacagtggcatggttgaaatgaagctgtgagccttctgctttaaatctgatgtaagaaactcctgttaacaaatagtaagtatgggttaattagccctttgatcaaagcctagctttacattgtttaggatctttggaaaacaattggtttggttgcccactttccgtagatcaagagcagaacctttcacatggcacagaagaacccaggttgcgcttcatacctgcatattccagccttagcctgccatttctctccttggcactttgtgtcccagcaacactgggtctcagttgggtcatcctcaaacttgggttccataatccagcctcaggaacctctgttcctgttactatggttccttgcatgtcgcctgctcttactaaagagctcgtgtgttttccagcacacttcggtttatctcttgatgatgatgctagtctctccctccgcaagggcgaaaggctgcctggttggttttgtaccagtgtttcctaacgtgtagctgcagtcagtatttggctaagctgttcccaggggctcaacagatgctttcggatgagccttaactgacccaatcctttgtgatgcgggagagattgctaggcctcgcttcacctgggccagaaccaggggaaagagggccgcggttgcagcgcgattccagggatgtggcctggttacctgccttctctgatacgtcaagacaccttcaacaatggcttgcagctgtaccctgttggctgcacccaggacgcccttttcactgctaagcagtcctacctgaggcccaggggctgccagattgacccataaataatctccggggccctcagatccagaagctgctgagcctgatcttagtgcccttctcctttctctgtgtgggccccccagccccttttccccattgccttgtgtccaaggccttttccttcatgtattccatgggagggagagacaaaattacacatcattaaattaagataggggattccttaattaggacattcaggaagtatgggccaacgggatttatctttaaaaccaatgggggggaggaggagttttcaattaaatgttgtgggacttccatttgtcaaagaccaaaacaaaggaaccccaaccttacatttagatatatgatccattttgagttaagtttgtattacatatctaaatgtaaaatgggaaagctataaaacatgaaaacagactatctttacaacctaggcgtaggtatagtttttagacattacaccaaaagcacatgccgtaaaagaacaaatagataaattgggtggatttcattaaaattaaaaaactttttctctctgaaaaatcctgttaagcctgggcgcttgtggttcatgcctgtaatcccagcactttgggaggctgagttgggaagaaattaattagcttgaggccagggagttcaagatcatcctgggcagcaaagtcatacactcttgagggaagagagagaccttctcntattgtcttatattgttttatattgttttatactcagtacctgttttaagaaaaaaacaaggaagtgaaattcaaagacaggcagcccggcaccagggccttgaaaccagccctggggccttgcctgggccttaaacctagttagtttaaaaattcaactttacggactttggaacctgatgttattccgtaggtttccaaggcttgtataaaaaaattgttgaaacttccctgttgtgttctgtacccgtggccttgaaacccctgtcacatatcccctagattgctcaatcaattcacggacccttttcatgtgaaatctttagtgttgtgagcccttaaaagggacagaaattgtggcacttgagggagctcagattttaaggctgtagcttgccgatgctcccagctcaccaaagcccttccttttccaaaaaaaaaaaaaaaaaaaaaaa

SEQ ID NO: 4041 - DNA, 1100 bp, Homo sapiens
cctgcataaccattgaagtttgcaacaccctaaaccccaccaccttgctccccgtatcagagagcccagttaaacataactgtgtagaggtgttggactcagtttattctagcaggcccaacctctgagaccatccttgaacatcagtagactggtagctgcacgtggacgggagcagcttcaccaacccctgcaaagtgacactctgaagaaggagacaagccctgctccagtcacaccgcagaagctgactgggtccacggcacagccgaagcatggagggaaacttcattcatggggacttcatttttccttaaaatttgggatttgttacagtaagggatttcaacttgaccttttcccaggattgagggattgtttcccagttattattacgttcaagttcaattgcgggtagggacaaaaggttgcctacagtccctattattttatgggttattataagtgtccccaggacctcctaaaagaaacttgtttgtataatgctattcctatcccaaggtatgtagccccaggaaataaccaacctgggtgcctgttatgacccattttaagcctcccatgatcacagtttttaaaataagactaaggacctgacggacctggtgggggctcataaactatatgagtaaagtgttagccaaaacagaagaaaaagagggtgccccaaaaatgtaaccttaaaatttgatgcctgtgctatcattaatagtaataagttgggaataaggtgtagttctctagattggaaaaaaaatgttacacagtaaaaaaaaaaataagtgtatctgtcataaattaggactgtgtggaaataaatgtaaatactggtcttgtgtcatttaggctacttgaaaagaggattaaaaaaagatcttgtttggctctgcaaaggaaaaggcagcccctcctgcatgagtgggagctgcaaccctttaaaattagtaatcacaaacccctcagacccaagtaaaataaaaaaaaatgtaacattaggcattgatggaaaagggctggatcttagtgtaagcatcctaataaaaggagaggttcaaaaacgctctccagaaccagtaaaa

SEQ ID NO: 4042 - DNA, 4430 bp, Homo sapiens
gagacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcggagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggccatgcagattgctttaaatggaccaccctaaagccagagacgggaagtggcccaaaacccggtcttttgcctggtcccttgtctttgccctctgctggcttcccccttcacctcagcaggattctgaagctcactctttataatcagaatgatcccaatagatgtgaacttttggagctttctgttggtattggactatattggtatcaacatggcttcactgaattcctgcattaacccatttgttctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccagggatattcacacaacacttaggcttaaaaatgagctcactcagaatttctattctttctaaaaagagatttatttttaaatcaatggggactctggatataaaggaagtaataagtcactgttaaaacagaactttttaaatggaaggcttaaattactcaatttaaaattttaaaatcctttaaaacaacttttcaattaatattatcacactattatcagattgtaattagatgccaaatggagagaagccagtttaagtggtggccatttttccgggacacggggaaaccatttaaaatggatcagggagggagtaaccaggaaagaggcaaggctgtttttgaaaatccattaacactttccactagaagccccaaaccctcagcattcctgcaatatgtaacccaacatgtcacaaacaagccagccatgtaacagactggcacatgtgcccagcctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttctttcactatcgtagcttaaactctgtttggttttgtcatctgtaaatacttacctacatacactgcatgtaggatgattaaatgagggcaggccctgtgctcatagctttacggatgggagagatgccagtgacctcataataaagactgtggaactgcctgggtgcagtggtccacatggacaaagggggcaggtaggcaccctctcttcacccatgctgtgggttaaatgggtttctaggcatatgtataatgctatagttaaaaatactatttttcaaaatcatacagattagtacatttaacagctacctgtaaagcttattactaatttttgtattatttttgtaaatagccaataggaaaagtttgcttgacatgggtgcttttctttcatctaggagggcaaaactgctttttgaggaccgtaaggaacctcttagctttgtggcgttcctggcctaatttttatatcttctaagcaaagtgccttagggatagcttggggatgaggatgtgtgtgaaagtatgtacaaggggaaaacgggagagagagggaatgaggtggggttggaggaaacccatggggacagattcccattcttagcctaaccgttcgtcattgcctccgtcacatcaatgcaaaaggtccctgattttgttccagcaaaacacagtgcaatgttcttcagagtgactttccgaaaataaattggggcccaagagctttaactccgggcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttaggattatttttattaccatgtactggaatttttacatcctggatacccttttcttctcccatgtcagtatcatgttctctaattatcttgcccaaattttggaaactacacacaaaaaagcatacttgcattatttataataaaattgcattcagtgggctttttaaaaaaaatgtttgattcaaaactttaacatactgataaggtaaggacacaattatgaatttctttacatactccaaaaccaggataggaaaagggtgctatccgttccaacttcaaaacatggttccccgggtattagggggcttttaatataggggccaccgggccaaaattattgttaaccatggatgttaccagcctcaaaagatttataaaggatttttaaccctattttctccccttattatcccactgcctaatgtggatgtatgttcaaacacccctttagtattgatagccttacatatggccccaaggaataccagtttatagcaaaaccatgggtatgctgtagcctaacttttataaaagtgtaatataaccaatgtaaaaaattatatatccgggaggattttttggttgccccaaagtggcctatagttacctgattttttattatgtaagcaaaacccaataaaaatttaagtttttttaacgaactaccttatttttcactgtacagacactaattcattaaatacttatttgattgttttaaacgaatataaatgttgacagtcggccattattaatgttaatatacaattatccagccagtatggagttattcaattaaaatgccgacatttctggtcaaaaaaaaaaaaaaaaaaaaaaaaa

SEQ ID NO: 4043 - DNA, 813 bp, Homo sapiens
ttttttttttttttttttttttttttttttttttttttttttttttttggaaaaacccaaaaacgggatttattggggggcccaagtcatcacctggaaagtcaagaaagcctttgaagtattcgcggggatcttcatgatgagcaggaacagggctcatcatggcaggactgtgatagagtcagaaactgactctcgtgaccttggcgcaccccactgcaggtaacggaaaagttccccctgttcccacaggcaaatgccaattacctcggcccacttccgtaagggtgcacagaacgaaacaaaatctgtcaaagctgggaacccaaggaaacttttgggttttaaatccatccatccagcaacctcaactgtcttccctcgaatcttcccctttcccactccatagatggatgttaatctgaggggatgaggttgaacgcaggcttgctaaggcgccttctcccacccacggcccctgggcgatctcccttggcgaacctttctcgttggggccaagttaacaaaggcttgcagagacccgagccccggaaacgttagccagaagccggaatccgaaggccgggcgagggctgggtcggatgggcttcccagaggccattggtcagcaagacttcggggtagcaacaaaaggcgggaaggccacaggcagcagcgccggcatccaaacaaaagacaggagcagagaggcctgggtggcagccacgtgattagaaaacagcgcgcaccatgtgacagtagaagaaggaccacctgcgcctccagagccagccaatcccggccctatcatgg

SEQ ID NO: 4044 - DNA, 1716 bp, Homo sapiens
aggggttttgtctgcggctcgtcctgctacatttcttggttccctgaccaggaaacgaggtaactgatggacagccgaggcagccccttaggcggcttaggcctcccctgtggagcatccctgaggcggactccggccagcccgagtgacgcgatccaaagagcactcccgggtaggaaattgccccggtggaatgcctcaccagagcagcgtgtagcagttccctgtggaggattaacacagtggctgaacaccgggaaggaactggcacttgggagtccggacatctgaaacttggaattgaagtgatctggcacgggaccctccagcacagtgttccagcaggtcctgttggagatgatatgttccattggcaagcctacaataatggggccaaatgacagtcccctatccagggtggagtatttttcttgacaattccatttccccaacagattaccccttcaaacccacctaaggttgcatttacaacaagaatttatcatcccaaatattaacagtaatggcagcatttggtcttgatattctacggttcacagtggtctccagcactaactatttcaaaaagtactcttgtcccatctgttcctctgttgtgtgatcccaattccaggatgatcctttagtggcctgagatttgctcggatctacaaaacaagatagagaaaacgtacaacagaatagctcggggaatgggactcaggaagtatggcggatgtaatttaaaggaaattattggggataacctctacaaataaagatacggggaactcttgaaagagaaagtccttttggatttccatttgactgctttctatgagcccacggcctcatcttcccctgtgcacatgtttacctgatacagcagtgctgccgtgttggtacatacttgggaaccaccaacctagaaatacttgtacttctggtaccaacattggcctcctaggcagagaagtgtgtgtgtgacaagccagttctacaggcattacctaggtgtgagacttaaaagcttttcttattgacttaaatttgggataacagcaaggtgtgaggggggtggtggggtatgggtgtgtgcttgggatggggaaagaaaaggctccactcacctataggagattatttttaagtggaatccatttaaactcaaaacagttatgaaaggccaaggtgaagaagaacatgaagctgtgtctgtaattcattttattcccgaaggagcttaccgtcttaagggtgaaaagttatgaccaacccagattaaaactctaccccaacatcctgccattttaaaggtctaaggtttaactggtcaaccatttaaatgggattgggagctattagtacatcaaagtgtgatggggccttgttcccaacctctttttacatctcccctacccccttccaacctttgggccctttcagcccttcctttctctctttccatattctttggtttgtatggtggtttctcgagttaatacataggctagatagctcttatttttccttaatgtttttaaccgcttagggtctatttggatgtaaggggtgaaaattcatttgatggaaatacttggtggtatatttaaagacccacaattgctcctctggagcttggtactttcacgcatgcatcaatctgtgtaataaacatagattaatacagtcattacatataaaaaaaaaaaaaaa

SEQ ID NO: 4045 - DNA, 13162 bp, Homo sapiens
tttcaatagttttacattcaggaggcctagttacttttaaattatacaacattttttgcataaattcttttttataacatttttctctttcttgacttttgcagacaattcttccacatgcctcaactttctgacttattacaaatatttctttctttaaacaaccagttaatttatttcaggacaagaatttaccatataatactctttttatataaattccacccgcccccttttttttccttttttttttttttttcccttaggatacttctgaactggtgaggtgtgctcacaatgaggtttcctcacaatgaggtttcctctaaaagttattctttttcccctttttttttttttttttgttagcgaagcagttgccgctacagattgaatgcatttgggccatccgcgggttatggggttaaggatttttgataggaaggctacgggttatcagtggcctccgtgcttttgggtaagtactcccaaggctacgcccttgtttacattgacgaaaagatggaatggctgcttagggagggtaaagctaggacaggggcagttactaatagatgttttaacctttctaccttttggatttctggtaattgccaaatgatggggtctggctcgtcttgtgtgagctttttgtatgagagttctgtttctagggcataagagtctatccatagacggcagtatctgactaatcctccttcaatccattcaagcccaattttccatttgcctttgtaattaaatgccctaaatattttacttcaggttctacaaattggagtttgtttttcgaggccgttaacccttcatcccacagaaaatgtaagacatgggttgagaaagctgctacttcttttctatcatctcctgaaattagaagatcatccatgtactggaggggacatatgcacgagggcagggaaaatttctctaggacttgttctaatatttgactaagtaaatatggagactccgtaaacccccggggtaagactgtccatcagtattgctgttttcaaccggagtgagggtctttccactcaaaggcaagtaggtcctggctgccctctgctaatggacaagcccagaaggcatcatttaaatccattactgtactatctgattaatagctctaaggtcttgcactaaccagtatgacctgtctggcttctttaaaggcagtattggagtgttacagggagacatacaggatttaagaagcccatcatggagaagaccttcaattacagagataaaaagtttttcttgtggaacaagttaacactagatggcagataacagactgaggagtgagctgcttctgactcgattaaaaaggtaataagcttaggtttaggtcccacttctaaatttaccaagggctgttggtgggactcaagagacaaagatggagcccctgacctccctagtcttcttcaaaagctgtaagtgggatgactttttcttctttttcccatttgggacattgtctttcaaaatgacctatttttccacatttgaaacatttgttctgtgatttcttagtaatatctcgccagctattggtgacaaagtggagctttaacattccttgtccgagggggtcttctgattctaggccagcgtatttttctcatttgctctttaagcctttctaaaaattctgtcggtccctcatcttttccctgttttatattaaaggccttggtaagattttgggtgcggggcactaattctcaaattccttttattaccatctccctaaggtctctcatatttccttgatgggctatattgttgttatctcattgaggatcctgggctgggaattatgttcagccgctggaacgttctgaccgggaggatgttcacgttcccgaatggtcatagcagccctttgtatcatgctcctttcttctcctgagaataagatgtctaagatagacattaactcgtctaaagtatatatctggggtcctaaaactgatcgatctgatctgccactccataagggtcatctaagagtggtttaagctccttttttaggtttaggggaagggtctgtggtggcagctgcttgggggagaggaaggttcttcagtccaaacaaaacagcagttttttatcatttgctgctttttcttgtgtttggtccttccattatccttccaatattctaacgttaggcctaggggactatcagagggtatattatcatgatcatgatatttcctatcttttgtcttacttgctgtatttcccatcctggagaaagagtttttccctgagtccatggggctcaatctctcttactagagatttcttgcaccctagtgagtctgtggggctcaacctctcctactagagatttttcacactcttcagcttttgctttatccttctccatatgcttctcttgcggaaattttcaagtccctcttagcataggcaggttggtataaaccccacaacaggcaagctgcctttaagccatatgaggtgactacagaaccagatccggactctgcacttgctctgcactcaattgtgtgtcttactcacacactttcaacctccaggatgtcctgaccaccaaggaaatacttcactgcccccaaggtttttcttaccttggtctatgcacagagttacctggtcgccacagtatctgtctgccttttcttccctcattgctagagtccaggtttattcatcacaccaggtgggtctcgatcccttacccttgaggccaccgcaacaaagcagcgggctgcgtctcctcacgagaaatgatctgagaccctccccggaggagaatgggaatcccagatgaacccccaagtttgttagaaacaagtgcctggtgccacaaagaaaaacagcacataggcagaaaattcctcagcaaggcaaatttacttctgcagaagggtgcagcttgtgctagtcacaatcgcaagagcacaccaagcagggtagggcaggggtttttaatccctaatgcagttcctagcacttctgtgtcctttccgcattggctggggttggacttcacaatctaagctaattcgattggctaagatttaaaattgaatagggtctattaggtgggaaggaagaggaactatccgttactaggtgggaaggcatatctggacttgtctgggcctggcgaaggcaggaaggctgtttacagaacaggtagctaggagacaaggatgtacaaggaagttggtcttaagaaacaaagaacagagaactaaacctttttgaagaggaatttatcatctctgacaggaggctgcagtgagctgagatcacgccattgcactccagcttgggcaatgagagtgaaactccgtctcaaattaaaattaaaattaaaaaataaaaaataacgtaaaataaaaaatggtttctctcccctctatgtgccagacaatgaggaaaagagaaaaaggagacacctctggaggccagggagctgagagccaccttgagaatgccaagctggggaagtgtttaggggaactacttcctgcttccttccgagcaaaacagtaaaaaataaaaatccctgagacaatacttccttagccttatgaaccccgaaaatctgagataggtctcagttaatttggaaagtttattttgccaaggttgaggacgcacacccatgacacagcaacaggaggtcctgacgatgtgcccaaagtggtcagagcacagtttggttttatacattctagggagacatgagacatcaatcaatatatgcaagatgaacattccttaggtctgggaaaggcaggacaactggaagccgggaggaggcttccaggtcttaggaagataagagacagatggttgcattcttttgagtttctgattagcctctccaaaagaggcaatcagatatgcatttatctcagtgagcagaggtctgacttcgaacagaatgggaggcgggtttgccctaagcagttcccaacttgacttttccctttaccttaagtgattttggggccccaagttattttcctttcacagcctactttcttccttccagaagtgactgtggacaattccacagggtttggacttgatcagggcagaaggtgaagctgcaaggtattagatgtgggaatggagaaaaatacaggctggagctgtgggtttgagtgttgtcctcataggaggtgatggctgaggggtaggtaagtgagaggatgagatccccgaggccgacagcacagagtgacaggagcatagggcaggactttgggtcacccaaggagacagtgatgcttttgaagaagtcagaggaggccccatcagcaatcagaggattgctctgattggcacctcagagctggaggacatcaaaaaataccgctgtaagaaagagacctggaaaagtctttagagattgtctatcccaccctacccatttgacacatgagaagatggaggccaagagatcactgagaaaataaatggtagagcttgggcaaaatcagtgctgcccaaaatggtgtttttccaacaaagacatttaaaaggttccttccacaaggatcaaacaccttggggttttgatttttatcttaaaaaattatataaatttagccttctacaggccaggcacggtggctcacacctataatcccagcactttgggaggctgaggtgggtggatcatgaggtcaggagatcaaaaggatcctggctgatatggtgaaaccccatctctactaaaaatacaaaaattagctgggcgtggtggtgggcgcatgtaatcccagctactcaggaggctgaggcaggagaattacttgaacctgggaggcagaggttgcagtgaaccgagatcgcgccattgcactccagtctggcgacagagcgagactccgtctctaaataaataaataaataaatttagccttctactcaagaacttatctggctttgtcttaatgtaaaaataatttctttttgctaaattattgagagaaatttactatttattagtgtttatcagttttctttaaactcaccactttttgatgaatatgaaaatctaaaaacttggccgggcgcagtggctcacacctgtaatctcagcactttgggaggccaaggtgggcggatcatctgaggtcaggagttcaagatcagcctgaccaacatggtgaaaccccttctctactaaaaatacaaaaattagctgggcgtggtggtgggtgcctgtaattgtagctactcgggaggctgaggcatgagaatcacttgaacccagaaagcagaggttgcagtgagctgagatggtgccactgcactccagcctgggcgacagagtgagactctgtcctaaaaaaaaaaaaaaaaaaaatggctgggcgtggtgcctcatgcctgtaatcccagcactttgggagtccagcgtgggtggatcacctgaggtcaggagttcaagtccagcctgaccaacatggtgaaatccccatctctactaaaaaaatacaaaaaaaatagccgggtgtggtggcacactcctgtaatcccagctactcaggaggctgaggcaggagaatcacttgaatttgggagctggagattgtagtgagccaagatggtgccattgcactccagtctgggtgacagagcaagattccgtctccaaaaaaaaaaaaaaaaaaaaaaaaaatagatgaagcagcttgacagatagcaagaccaaaacccatggtcaagatttaaaccaaaaatcaggataaatttttctctcacaaacctgaaagctaaagtgaacggggagcaaaccactagtaaccacaagacttgcatgctattggtatttgaacaaaacaagatagagagaagcaacatgagacagatctgacagggggagaacccaaaacagcccacacaagtgcactgtagatcatggtgagccaatgtgagaataaaagctgaccctccaggactcccttctggggcaggaactcactgtaaggataaactgcgtgaacaaaatcaaaattgatcaagagagcaacaatagaacaagagaagagaaagactagataaaagtaagaagagaacagacgtgaaaatctcagaaagttagataccatgtttccaccattatatcaaagaacagaagaacagattttgtgaaattagaaaagctatgtgaacataaatatgaacaagagaaatgtattgaggtcaaatctcatacaaagtaacttaaaaggagagaatgaacagaaaaaggggaagaccattatttatatggccaattcaagaatttctgaatatgctcaagaaacagaacaacaaaaatctttgtaacctacagtttcaaaacgagttacaaaacactaagaaaacaatataaaatgtaaaagagcatcacaaattataattaggaaactcagcaatgaggtgacagaactaggaaagaattaaggggaaataagggacaagagagaccctctcatattgttttatattgttttatactcagaaaaggaaagagaagccaaacaaaaggcaggtaacccagcgcctaggaaccagacccgaaaccaaggaaccagatctgaaaccaggcctgggcctgccctgccctaagcctggtagtaaaaattccacccctgacctgacctggcaactgttgttatctacagattcccagacattgtatagaagaacatttgtgaaacctcccctgccctgttctgtttctctctaccagtgcacgaaacccctgtgtatatatcttggactgtagtccctgttacgtatcccctagattgctcaaatcaatcagtcactatcctttcatctgaaatctttagtgttgtgagcccttaaaagggacagaaattgtgcactcggggagcttggattttaaggcagtagcttgccaatgctcccagctgattaaagccactcccttcactatcttggtgtctgaggggttttgtctgcggcttgtcctgctacatttcttggttccctgaccaggaagcgaggtgattaacggatggttgaggcagctccttaggcgactttagcctgccctgtggaacatccctgcgggggactccaaccagccaaagcaacgcggatcctgagagtgctcctgggtaggcacttgccctgatgggacgccttgccagagcagtgtgtggcaggcccccgtggaggatcagcacagtggctgaacaccaggaaggaactggcacttggcacttggagtccggacgtctcaaactcggtaagactagtctttggaacttgcccactccatttgagtggaagcgtggcctgatcacccactttgtgcctttatgggctctttggtttttgtttttgttttgacttggtttgaattgcttgacaggattgatcttgggaacttgcctactccattcaagtggaagcatggcctgatcacccatggtatgcctgtatcggcactttgttttttgtttttgacttgacttagattgcttgatactttggttttggttttgacctggcttggatttcctgatactccgattttggttttgattctggtttggtgtaaactgtaaaagtgtgtgtgtgccctttttacccgttctttgttttgtagtgtgcgtgtggtgtgagcgtggtgttttgtctcgaggagacacgggtcaggtacaaactaagcccaccccactaggaactatgttgaaaaatttcaagaaagaatttaagggagattacggtgttactatgataccaggaaaacttagaactttgtgtgaaatagactggccagcatttgaggtgggttggccatcagaaggaagcctagacaggtcccttgtttcagaggtatggcacaaggtaacctgtaagccaaggcacgcagaccagtttccgtacatagacacttggttacagctggttttagaccccctccctacccccacggtggttgagagaacagcagcataagcagctggcagaggcaaggaaagaccagcagacagaaagagagaggcagaaagagaggaagaaacagaggcaaagagagaggaaaagacacagaggaagagacagagagacaaagaaggagtcaagaaaagagagagagacagagaaagatagaggcaggaaagagaggaagagacaaaggccaaaggaaagtcagagagagagacagaaagtcaaagagagaaagaacaagagagagaaatatccaagtagttaagaaaaatacaatatacctgattcctttaaaagccaaggcatatttaaaacctataattgataattaaaggtattctcagtaaccctgtaacactgtaataccactttgttgtcagtgtaaacaagggggtatccggaaagcactgaggccttcctatcagaaacccttaacccagtaacctgcggatggcccagatgtgttcaatctgtagcggcagctgctttgctaacagggaaaaaaaaaaaaaaaaaaaaggccatttatacaaattttaagttaatttagactaaacaggtttttattaatagcaaagaataattgaaatcccaaaattacaaggttttcaacaaaaagtaaagtttgctaaaagttaacagtgtaacatggtatttatcctaacttctaatcttgtggccttagacagtctaggtccacagacatgaaggaagttcgctttaaaaaaaaaaaacagaatggttatcatcttcaaaaaaaaggggggaaaaaagaaggggcagaatttatctaaaaaaaaaaatgttatatggtaaattcttgtcctaaaataaattaactggttgtttaaagaaagggatgtttgcaactaagtcactaaagttgaggcatgttgaagaattgtctgtgaaagtcatgaaagagaaaaaaaagttataaaaaaagaatttatgcaagaaatgttgtacaatttaaaagtaattaggcctcctgaatgtaaaactattgaaaaaaacagtttatgtgaaaggtgtcataagaaaagtaaactatacctctggtaaaaggattataaggaggcctcagaatgtaaatttttacctacattaaaaggttaaaaaaaagttttcttttgaaggcttaagcaagttttaaaacattaatcataaagaaaattctgtgtgtaaacatattagctaaagttaaagaggtatcatccagttttttctgtgaaatggacattaaagtaaaaatgcaacagttttcttaaagcaccaatctcctctttaacaaaaattataaaaggttaaaaagagtcctataaaaatccttacccttatgggtcccaacattaaaaattgaataaatatgtcctacgaagttttattaaaactaagtttaacattaataacacactaatataaaggtaaaatttagcttatctggtataaaagtcatacaggaagcattagtaaatataaaatagcgtttagctttcttttgtctaaaaactaataaaaattggtgctaaaggaagcattcattttactagaggatcataaaagttaaagacttaaaacaaactttgggcaattaagacagcataccaaggatgcaaatgcctgggttgaaatgggatcaaatattccatctgcagggttaaacaaaaggcaattaggcatgcttgtgccacatgggcagggccaggaggaccctggattgtccccccgctccactagggtgggtcctcccagtcgggccaggcatgggctgcatggtagctcttttccagggattctataggcctgggagtaataaagtcatgccaagctctctctgctaatatcccaaagtctggtaccctgccaggtacaagccccgaaggcccatccagcttcccatctccccaacactaagttttactacgtgtctctcatggccaggggaggaagacttagccattccttggaagacctgaagggatgcagtgagcttaagaattttcaagagcttatcactcagtcagcccttgttccatcccaaagcggatgtgtggtggtattgtggtagacctttattggggactctgccggagtaactagagtggcacttgtgctttagtccatttggctatccctttcaccctgacatttcatcaacaagaggaaaaaataataataagaagaagacatcataaagcgagaaaagccccttataggtctttcaactctcacatctatttagacgcagttgggagtcccacgaaggaataccagatcaatttaaagcttgaaatcaaatagttacaggatttaagtcaatattttagtagatgacagtcaacaaaaatgtagattagataaactacatctattacaaccaacagcaaagagcttttcatgagttgaaaaaaagaaaaaacccatgtcggccccagccctggggctacctgacctgacaaaaccttttacactctatgtgtcaaaaaaaaaaaaaaaaaaatggcagttggagttttaacccagactgtaaggtcctggccaaggccagtggccttagctctcaaaacaattagatggggtttccaaaggctgggccccatgtccaaagtccctggcagcaagggcccgtgttagcacaagaagcaaataagctaactcttaggcaaaacctgaatataaagacccccccatgctgtggtgaattttaaataaataccaaaggacgtcattagctaacaaatactagactgactgactagataccaaaagcttgctcctgtgaaaaaatcccccacataaccattgaaagtttgcaacacccctaaaacccccgccaccttgctccctggtatcagagaagcccagttgaacataactgtgtagagttattggactcagtttattcctatgtggggcctaacctccaagaccatcctttaaacatcagtagactgggagctgtaacatggatggggagcagctttcaccaacccctgcaaagtgactctggaagaagatgggcaagccctgtttccagtgcacacccgggaagcttgactggtccacggcggcggccaaagcattgagggaaattcatcgcgggactcattttccttaaaatttggacttgcacagtaaggacttcaactgaccttcctcagactgaggactgttcccaggatatacatcaagtcactgaggtaggataaaagattgctacagtcctattactttatggttattataagtgtaccgggactctaaaagaaacttgtttgcataatgctattctatccaaggtatgtagcgcagtctctaaatgttatgtttgtggaggaactgtaacaggagatcaatggccataagaagcctgagaattagagcctacagacccagttcctgatgaattcccagccctaaagaatcaccctgatcatttctaggttctaaaagtctcaattattgcattagctaaacaacaacaacaacaacaacaaaaacaggaaaagaattcactcattctgtaagatgacttagttgtctaaagcaaaaactgtgtaatagtaccacaaaaacagttacgtggtggagttcaaaacacacagataaaaatccattcagtagatttccaaagttgcagaccatttaagcccacccagaatcccaccgggactggacggccccactaggctatactgggtatgtggacatagaacctacgctaagctgcctgaccagtggtcaggtagttgtattattggcactattaaaccatctttcttcctactacccataaaaagagcaaactcctgggcttccctgtctatgcttcctgcaaaaagaaaagcatagctataaaaaaattcaaaaataatgaatagccccctaagcaaatcatacaatattataggcctggtacttaggcacaagacagctcatggggataccagacccccatttacatgctcaactgaatcatatggttgcaggctgttctagaaatcatcactaataaaacctgtcaagccttgactattctggcccggcaagaaactcagataagaaatgctatctatcaaaatagattggctctcgactacttgctagcagctgaaagagaggtctataagaaatttaaccttactagttactgtctacacatagataatcaaaggcaagtagttaaagacatagttaaaaatatgacaaaactggcacatgtgcctgtacaagtgtaacatggattcgaccctgaagccatgtttagaaggtggttcccagcactaagaaaatttaaaactcttataataagagttataatagtaataggaacctgcttactgctcccttgtttgctacctgtacttcttcaaatgataaaaaacttcgtcgcttaaccttagttcaccaaaatgcttcagcacaagcatactatataaatcactatcaatctattgcacgaaaatacataagtagcaaaaataagagtgagaactcccactgataaaaagtgagagtctcaaagggggggaaatgagggaagagagagaccctctcatgttgttttatactcagaaaaggaaagagaagagaaacagaaggcaggtagcccagcacctaggaaccagacctgaaaccaaggaaccagatctgaaaccaggcctgggcctgcctgacctaagcctggtagtaaaaattccacccctgacctagcaactgttgttatctatagattccagacattgtatggaaggaccttgtgaaacctcccgttctattctgtttcactctgtccatcggtgctcacagccccgtcacataccccctggcttgctcaatcaatcacgaccctctcatgtggacccccttagggttgttagcccttaaaagggacagaagttgagcacctgaggagctcggattttaagacgctaggctgctgatgctcccagctgattaaagccactcccttcactatctcggtgtctgaggggttttgtctgtggctcatcctgctacacagtaacctactgtttcaaaatgagttagaaaacactaagaaaacaatataaaatgtaaaagagcatcacaaattataattagaaaactcagcaatgaggtgacaaaactgggaaagaattag

SEQ ID NO: 4046 - DNA, 2719 bp, Homo sapiens
  misc_feature (1)...(2719): n = A,T,C or G
ttcctttctagaggccgggaagttaaacttgtagccaccacctccgctcttcccggtcaccctcgcccccacttcgggccgaaagcacggtacagaggctgttggtggctttgcacggcaccccacccaccccggatcgcggctgtcttaagggacccggagttcattaagggctctttcggggcctctgcgagtgtctgatctgctccgtttttgcaaaaagcgcctctgtctcgcagagctcgtgtgagatcgatgacaatcctgccccgccgccgggataatcaagagttttggccggacctttgagcatacaccgagagaagtgaggaagccagacgacaagcacacactattggcgctgaaacaggattaataaggaacttagtgatttggcccgtgaccctccagcacaatgttctgcaaggtccagttgggggatgatatgtttcatttggaaagccacaattaatggggacctaatgacaagcccatattcaagggcggtgtattctttttgacacttcattttcctacaagactaccccttcaaaccaccttaaggtttgcattttacaacaagattttattcatcccaaatatttaacagtaatgggcagcatttgtcttcgatattcctaagattcacagtggtcgccttgcatttaacaatttctaaagttcttttatccattttgttcactgctattgtgatccaaacccaggatggaccccctagtgccaggggattggcacgggtcttattaaaacaggacaggagataagtacaacagaatatctcgggaatggactcagaagtatgccatgtgatgctaccttaaagtcagaataacctgcattataggctggggataaacttttaaattactgttccttttttgattttcttaatccggctgctcccctatcaggacctcatcttttttaattttattttttgtttacctccctccattcattcacatggctcatctggggaagacttaaggttctttcccagctttggggacaataactggtttttgggaaacctgttaaagtaggttacaagaggaacagttgcccaaggactcaggaattttttaaaaaaaaaaatggggggcctgtggtattatgtggccaatggtcttcacatcataacttgggttatgagacctaaaacccattcccctcacctgcctcctaacatgcctgaagaaatccatcctgaggggggagggagatgggatgctcatgttgtcacatccaaaggataccagcattattcctagcagcatcccattcttgtttaagccctccccactgttagagatttgaggttaccatggatatgcctttatgcctcataactggatgtggcccgggaaaaatgggtaattggaatttaatagccatccagccagaaccagaaaatgtgaatgtattttatgcaatgtcaataaagggaatgaccctgttcttggttctacaagagaatgggaaattgggaagtcaaacacccttttggtattcccaaaatagggtcctcaaacattttgtaattttcatttaaattggttaaggaggccttggaagctattagttaatctatcttcccaatacactgtttaatataggcactggaataaatgatgccaagttgtcaatgggatgagtgatcaactaatgagctctgcttaggtaattggatttatttttctttcaattaaagttgccattaaaccaatggagttaggctgcccgggtttaatcagtatgggggaaaccatctttttgttaaatgcaaaagcttgttttttgtatatacccgttggggatttgcctcattgttggacctccaaatgatgatgtaaagttccgaaagacgtgaatattttgccatggtccagttaaagtgcaccagtctgttaccaggttgaccacattgcctgaccctgatttatgccagaattaaaaaagcctatttgggattaggtgtagcctttaaatggtgctgccacatggatactggccagcccctaggagttcataggatgggactttttggggacccccagcagttttgaaaatgtgtttaagggagtttaaagaaatttatttccccccggtgccagcccccgtcctaacctgaaatttccccttcacccttgtacacttgacaggctgaaaaaaaaacaacatgggagtaaataatgggtcaaaatttgtccncaaaaagaaactccctgttttggtgtggggagttgtcatgaggctgtgttgaagtgacttatctatgtgggatattgagtatccattgaaatggatttgttcagcccatttacattaatgagcatttaaatgcaacagatatcatttcaggtgacttaactttgaatgaataaaagtcaatgctattgggattgttttttgtttgacaagtgctatctgtggccactggattttaacttctgtaggtaacagggggcattacccttcttcacctttcccaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaaaaa

SEQ ID NO: 4047 - DNA, 722 bp, Homo sapiens
aaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaaaaaaaaaaaaaaaaaaaaaaaaaaaaaaaaaaa

SEQ ID NO: 4048 - DNA, 1127 bp, Homo sapiens
acgggagcctgagggtttagaccctgcctccatgaaggtctgtctctgtcccagatgaactgctatcagagtccatttctgcattctcattatggagcctctccagcactttctgacgtatcagtcccaggcgcatcaagagggactggtagtcaaaagtggccccgcttctctcccaaaagggtcctgcataagtttggccttgaaggtgcaggcgatctttgcaggccacctcgtagaagtcgtaatactccagaaaggacttctccatccatcacccctcgtaggggttccaggacagggaacactttcccttccatcatgtcaacagactgcaactctgatggtctcgtgccggatacattcattatagtttttgctgtctccctggatgtctctcctgttcaaagccgggctcattgtgataggggttctcagtcatcagggactggatagagatgagcactgaggagatgctctgggctgggctccaggcaggtccagtccatgtacctagaatactcaagcagactttcccattgcggtagaagttggggttaaacctcactgtgttattgcccgttgtcatcagtttgacccgaggtgggtggatgggatagtcgggcggacaccgaaacacgaacaggaagaaacccccttcataaggagtgtcaaatgggcctgtgatcaatgcatgaatcttagtcatgtcaacagtatcaggtacaacgaacattcctggaggaggctccttataaatggacatgatatcccgcttgatccggagtagacactgcggcgcggtgcgctcgccgtcccagtcggagctgagcgtggggtcccagtggctaagcagcgcggccccgtgggcagcggctgagggcgggagcccgggcagcggagccaggccgctccccgggcccccggccccgcccgctgccgccgccgccgcccacacatccggcaggaaaggcggcccgaacccgccgccgctgccgctaacgccaacaacaccagcaacgctgctcgccccggggcccgccgccccggcgcccgccgttgccgcctcctcagtcggactctccgccatcgctgcttcgcttccgggactactcggcagcacgtcc

SEQ ID NO: 4049 - DNA, 574 bp, Homo sapiens
ctcgtaggggttcaggacagggacacttccttccatcatgtcacagactgcaactctgatggtctcgtgccggatacattcattatagtttttgctgtctcctggatgtctctcctgttcaaagccgggctcattgtgataggggttctcagtcatcagggactggatagagatgagcactgaggagatgctctgggctgggctccaggcaggtccagtccatgtacgcttgatccggagtagacactgcggcgcggtgcgctcgccgtcccagtcggagctgagcgtggggtcccagtggctaagcagcgcggccccgtgggcagcggctgagggcgggagcccgggcagcggagccaggccgctccccgggcccccggccccgcccgctgccgccgccgccgcccacacatccggcaggaaaggcggcccgaacccgccgccgctgccgctaacgccaacaacaccagcaacgctgctcgccccggggcccgccgccccggcgcccgccgttgccgcctcctcagtcggactctccgccatcgctgcttcgcttccggaaatactcggcagc

SEQ ID NO: 4050 - DNA, 675 bp, Homo sapiens
cagtaagtcagcccaacattgttttctaggtaaagaggaaaaaaaaaacatggctgataaagctaatacagtcaactaggaacactaagaaattttcttttctttcttttttgagacaaaaaacaacaaccaaaaaaaccagatttttggccccaacccaggagtttcttttgtaggtctaagatagggccccagaaactgctcggctacaagttcccagatgctcagggccacactcttaagagaaccacttctcaaaggttaccactgtaataaattaacttctcccctctgcatctagaatgatactagtcacataccatcctgaggagatttgagaagagtcactcaatcattttctgtgttctgtagttcagatgagggactccggttgataaaggctgacctagagtaattatctgctaacaaccgacttggctacttaaaagtctcctcttaccctagaatactcaagcagactttcccattgcggtagaagttggggttaaacctcactgtgttattgcccgttgtcatcagtttgacccgaggtgggtggatgggatagtcgggcggacaccgaaacacgaacaggaagaaacccccttcataaggagtgtcaaatgggcctgtgatcaatgcatgaatctgcaaaataaaaccccatctcaaaag

SEQ ID NO: 4051 - DNA, 474 bp, Homo sapiens
atactacccttttggccaggaggaactttgcatttaattaattaattaacatttgtatagcatttttgtcaaatgtatcatctcagtcttcactgcccctccccccacccccaccttgggttgatggtatttgccctgttttgtagatgaagaaatgtggatgctaaggctctaatcacctacccacccttatggaaaggtggagggcatctccctgatttaattagctgatttatttatttattttatttatttactttttttgaggacagggatcttgctctgtcaccagggctggagtgcagtgggtgcgatcatgggctcactgcagcctgggacctctcggggctcaaggcaggtcctcaggcctcctgaggtaggctgaggactacaggacatgtggccaccacgcccaggctaggtttttaaatattttttgtaggaggatggggggggtctcgctggtgttggccc

SEQ ID NO: 4052 - DNA, 468 bp, Homo sapiens
acacaaaaaccctttcccattccgtgctataactagttagcatttaaattgggtggatgtggtataactagtgccttgttgatattgatgcatatttacatggttttgctgttataaacaatggtccccttgctattataaatcacactgcttataagtacccttgcatctaaattactccaaatgtgtaactatatgggtgggataattcctagaagtgggattgtggaaccaaagttttaggtgccattggtaatttggatttataaccaatcttttcactgatctacttctctgcctctaatttctactaggtgtttgtttgtttgtttgtttgttttgagacagggtcttgctctgtcacccaggctggaggacagtggtgcaatcacggctcactgcagcctcaacctgccacctcagcctcctgaatagttggggtgtgtggcaggtgtataccaccacttc

SEQ ID NO: 4053 - DNA, 1534 bp, Homo sapiens
tttttttttttttttttttttttttttccagaggaaatgtttcgttttatttttgctcataacctcccaaaaaaatcagtaccccgccatccctcacccagacacagcccctctccaacaccttcacgaaacactgattttttttcttagagctaaaatgaacacccagtcaccaactacagccctgccctgcccctcctcccactggcctgctcatcttcccgcactgcaaacctggccgcctttagcctccctcccttagcgtagtgtcccaaggtcacctagcctgctttttgcctgtaggatatgggtccccttctcaaagcccgccctgacttacttcctcatttgcatagtccttcagctctatcctgtcgccactccacccaccccagacaaccacctgtaagaaaccaggtttgaaattcaagagaccaggtttccaagctcccagctgcttccctgtgggcctcggtgcctcggctgttatgtgacgggcatagacattgactaaggccaaacatttcatgatttggacgagaaaggagggaaggagatccagaaatacgcaagagaggtgataagcagagacagaggataaaaggataagagtagagaggagttgggtggtttggtggggaagaagggttgatttttttttttaatagagacagggtcttactatgttgcccaggctggtattgacctcctggcctcaaacgatcctcctgccttggctcccaaagtgctgggattacaagcataagccactgcacccggccgagaggggtttggaatgaaggtagaggcagggggatgaaggcgccagagctgaagaccagcccccagaagccacacccctgcccttctagcagctacgggtcctctggctccgggccttgtaaacctcgatgagcaggtccttgacgtactggatctcgcgctccacggactctgcccgttccttcagctcgcgattccgtgcctccagcccctggcactcgccctccagggcctcaccctctgcccgcttccgctggcggtacctcagagccgccgacttgttctggtctctcttcttttgcttgcggtcccctcgggtggtggcaggatgtgggtagggggccaggcgagaaggttgaggtggagaaggaggagggggctgctgtggcgggggcagaggcggcatccccacttcctcctgcccggcctcgttgcggcagtagatggccagcaagtccagagtatccaagacagggggctgggggaggtcaaaggaggggagggacagggggagggagggggctggtggtagtggtggtggtggtagtggcggcggggagggtggtgggaggggcggggcatctaggaagaagtcttccatctgttccagctccttcttgaggagggaggccatagcttccaggtcaggtggggttggggaaggttgggggagggtgccggggggtaagggaggctccagagggaggagagctgtgaaatcaactcgctcagtcatccagtcagagaagcc

SEQ ID NO: 4054 - DNA, 889 bp, Homo sapiens
tacttacttagagctcgacgtcttacttacttagagctcgacgtcttacttacttagagctcgacgtcttacttacttagagctcgacgtcttacttacttagagctcgacgtcttacttacttagagctcgacgtcttacttacttagagctcgacgtcttacttacttagcggccgcactagtctcgagttttttttttttttttttaatagagacagggtcttactatgttgcccaggctggtattgacctcctggcctcaaacgatcctcctgccttggcctcccaaagtgctgggattacaagcataagccactgcacccggccgagaggggtttggaatgaaggtagaggcagggggatgaaggcgccagagctgaagaccagcccccagaagccacacccctgcccttctagcagctacgggtcctctggctccgggccttgtaaacctcgatgagcaggtccttgacgtactggatctcgcgctccacggactctgcccgttccttcagctcgcgattccgtgcctccagcccctggcactcgccctccagggcctcaccctctgcccgcttccgctggcggtacctcagagccgccgacttgttctggtctctcttcttttgcttgcggtcccctcgggtggtggcaggatgtgggtagggggccaggcgagaaggttgaggtggagaaggaggagggggctgctgtggcgggggcagaggcggcatccccacttcctcctgcccggcctcgttgcggcagtagatctcgtgccggcaagtccagagtatccaagacagggggctgggggaggtcaaaggagggtggtgggaggagcggggaatctaggaagaagtcttccatctgttccagctccttct

SEQ ID NO: 4055 - DNA, 599 bp, Homo sapiens
  misc_feature (1)...(599): n = A,T,C or G
tttccagaaggaaatgtttcgttttatttttgctcataacctcccaaaaaaatcagtaccccgccatccctcacccagacacagcccctctccaacaccttcacgaaacactgatttttttttcttagagctaaaatgaacacccagtcaccaactacagccctgccctgcccctcctcccactggcctgctcatcttcccgcactgcaaacctggggccgcctttagcctccctcccttaggcgtaggtgttcccaagggtcacctaggcctgcttttttgcctgtaggggatatgggggtccccttnttcaaaggcccgccctggactttactttcctcatttggcatagggtcctttcaggcttcttatcctggtcgggccaatttcaccccaccccaggacaaaccacctgtaggggaaacagggggggtttcgaaattcaaggaggacagggggggttttccaagggtttccaggttggtttcctgtgggggggctcggggtgcctcgggtggttatggtnacgggggggatagggacatttgantaggggggccaactttcatgattggggcgnggaagggnggggaaggggg

SEQ ID NO: 4056 - DNA, 326 bp, Homo sapiens
  misc_feature (1)...(326): n = A,T,C or G
ttaaaatttacccntcactnaaggggnataaagcttttcgngcccccnattttttttttttttttttttaatagagacagggtcttactatgttgcccaggctggtattgacctcctggcctcaaacgatcctcctgccttggcctcccaaagtgctgggattacaagcataagccactgcacccggccgagaggggtttggaatgaaggtagaggcagggggatgaaggcgccagagctgaagaccagcccccagaagccacacccctgcccttctagcagctacgggtcctctggctccgggccttgtantctntcgatgagca

SEQ ID NO: 4057 - DNA, 256 bp, Homo sapiens
ttttttttcagaggaaatgtttcgttttatttttgctcataacctcccaaaaaaatcagtaccccgccatccctcacccagacacagcccctctccaacaccttcacgaaacactgattttttttctgcagagctaaaatgaacacccagagtatccaagacagggggctgggggaggtcaaaggaggggagggacagggggagggagggggctggtggtagtggtggtggtggtagtggcggcggggagggtggt

SEQ ID NO: 4058 - DNA, 429 bp, Homo sapiens
  misc_feature (1)...(429): n = A,T,C or G
tcccaaacccccctgccaacttcccccttccccaagccctcaacccctnccttgccccccttccgctggcggtaaccctcaaaaccccccaacttgttcctggtcctctccttcttttgccttgcggttcccctcgggtggtggccaggaatgtgggtagggggccccagcgaagaaggttgaggtggaagaaggaggagggggctgctgtggcgggggcagaggcggcatccccacttcctcctgcccggcctcgttgcggcagtagatggccagcaagtccagagtatccaagacagggggctgggggaggtcaaaggaggggagggacagggggagggagggggctggtggtagtggtggtggtggtagtggcggcggggagggtggtgggaggagcggggcatctaggaagaagtcttccaatct

SEQ ID NO: 4059 - DNA, 248 bp, Homo sapiens
tttttttttttcagaggaaatgtttcgttttatttttgctcataacctcccaaaaaaatcagtaccccggcatccctcagccagaaacaggccctctccaacaccttcacgaaacactgattttttttcttagagctaaaatgaacacccagtcagagaagccatcacctgccaggggctctccccccactggaagcccgccctccagcgtcccccaaggacctcatagggagccaggggggcagggg

SEQ ID NO: 4060 - DNA, 209 bp, Homo sapiens
  misc_feature (1)...(209): n = A,T,C or G
cagaggaaatgtttcgttttatttttgctcataacctcccaaaaaaatgaacacccagtcaccaactacagccctgccctgcccctcctcccactggcctgctcatcttcccgcactgnaaacctggntgcctttagcctccctcccttagcgtagtgtcccaaggtcacctagcctgctttttgcctgtaggatatgggtccccttct

SEQ ID NO: 4061 - DNA, 2214 bp, Homo sapiens
  misc_feature (1)...(2214): n = A,T,C or G
agagatgtcttcagctcaaatgctatcaaactggtgaaataaacagcgttgttgctcacacaaagcctgtttggtagtctcttcacatggacgcgtgtgacatttggtgctgaagacccgggacaggaggactccttcaggagacgggtcccctgtccttgngcccctccgtgaggagatccacctacgacctcaggtcctcagaccaaccagcccaaggaacatctcatgaatttcaaatcggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgtccatcggacagccagcctaatccctcctcttcctcctggaagtcgcaagtactctcccccacttcccttaaactcactcatatttctgaagaacagtaataacccttatgggcctaatacatcccttcattctattaggtctgttcatccttaccctactttttgcaacagggctttacgaagtcaccccaccacttaggccaagccccaaaaaactagtcatccctattatcttctgtccggtcatactcctattctccattctcaactacttataaatgccctactcttgtttacaccgccggtttacactgtttcttcaagccatcacagctgatatctcttggtgctatccccaaactgccactcttaactccgtcttagagtggatagatgatctttgctggcaaggcaccctccaatacttccaccctgatgaagttctattctttacttttatactcactcttattctcattcccattcttatgtcatcctctacctctccccagctatctccaccacactatcaaccttacccattctctcctagccgcttctaatccctccttagtgaacaactgctggctttgcatttccctttcttccagtgcctacacagctgtccccgccgtacagacagactgggcaacatctcccatctccctacacctccgaacttcctttaacagccctcacctttaccctcctgaagaactcatttactttctagacaggtccagcaagacttccccagacatttcacatcagcaagctgccgccctccttcgcacttatttaaaaaacctttctccttatatcaactctactccccccatatttggacctctcacaacacaaactactattcctgtggccgctcctttgtgtatctcttggcaaagacccactggaattcccctaggtaatctttcaccttctcgatgttcctttactcttcatctccgaagtccaactacaaacatcaatgaaacaattggagccttccagctccatattacagacaagccctctatcaatactgacaaacttaaaaacattagcagtaattattgcttaggaagacacttgccctgtatttcactccatccttggctatcttccccttgctcatcagactctcctcccaggccctcttcttgtttacttatacccagccccgaaaataacagtgaaagattgctcgtagatactcgacgttttctcatacaccatgaaaatcgaaccttcccctctacgcagttaccccatcagtccccattacaacctctgacagctgccgccctagctggatccctaggagtctgggtacaagacacccctttcggcactccttctcacctttttactttacatctccagttttgcctcgcacaaggtctcttcttcctctgtggatcctctacctacatgtgcctacctgccaattggacaggcacatgtacactagtcttccttacccccaaaattcaatttgcaaatgggaccgaagagctccctgttcccctcatgacaccgacacaacaaaaaagagttattccactaattcccttgatggtcggtttaggactttctgcctccactgttgctctcggtactggaatagcaggcatttcaacgtctgtcatgaccttccgtagcctgtctaatgacttctctgctagcatcacagacatatcacaaactttatcagtcctccaggcccaagttgactctttagctgcagttgtcctccaaaaccgccgaggccttgacttactcactgctgaaaaa

SEQ ID NO: 4062 - DNA, 2261 bp, Homo sapiens
  misc_feature (1)...(2261): n = A,T,C or G
tatccgtgangaagatccaccctangacctgggggtcctaaagaccaaacaagcccaaaggaaacatctcatgaaatttnaaaatnggggaccccnactgggaaatcgggantggtcccaaccngggaaggccactcccccagggccccctagaactctggcccaaaggctctctgactgactccttcccagatcttctcagcttagcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactgccgtccagcctgcaggatcctccccactgggttcaccgttccagaataaagttgtattcatcagacagacagcctgatatcttctcttcctcctggaaattgcaagtactctcccctacttccctaaactcactcacatttctgaagaacagtaatgacccttatgagcctaatacatcccttcatttattaggtctatccatccttatgctactctttgcaacggggctttacgcagtcacccccactacttggactgcaccccaaaaaacttgtcatcccttctatattctgtctagccatactcctattcaccattctcaactactcataaatgacctgctcttgtttacactgccggtttacattgtttctccaagccatcacagctgatatctcctggtgctatccccaaaccgccactcttgactccctcttggagtggatagatgatcttttctgacagggcaccctccaatacttccgccctgatgaagttctatcctttacttttatactcactcttattctcattcccattcttatgccactctctacctctccctagttacctccagcatactagcaatctcatccactttgtcctcactgccgccaatccttctctagcaaagaattgttggctatgcatttccctttcttcctgctcttacacagccatccccgctctacaggccgactgggctacctctcccacctccctgcacctcagaacctcctttaatagccctcactttacgcgcctgaggaacttctttactttctagacagatttggtgagaactccccagacatttcacatcaataagctgtcacacttctccgcatctacttacggcacctttctccttatgtcaattccacgcccccatatttggactgctaaccacgcaaacaactatccctgttgccactcctttatgcatctctcgacaacagcctactggaatccctttaggcaaccttccactgtccaaatgttcctttactctttatctccagaacccagccacacacattaccaaacagatgggagcattccaacttcacgttactgataagccctctatcattactgacaaactgaaaaacattggcagtcactattgtttaggaagacacctaccctgcatctcactgcatccttcgctaccctccccctgctcatctgaatctcctcctagcccctcctcttgcttgcttatacccagccccatgaatagcagtgaaagtttacttgtagacactatgcactttctcatataccatgagaaccgaacccctccctctatgcagttgcaccatcaatccccattacaatctgtaacagctgctgcccttgctggatctctaggatttggggtgcaggattcctctttcagtacaccctctaaccttttcactttacatttccagttctgcctgacacaaggtctcttctttttatgcggctcttccacctacatgtgcctacctgccaactggacaagcacatgtactctagtcttccttacccccaaaatccagtttgcaggtgggaatgaacaactgcggtccccctcatgacgccaacacgaccaaaaagagtcatccgactaatccctttacttgtgggtctacgactttctgcttccactattgtacttggaacttgaatagcaggcatttcaacctctgtcacaacattctgcagcctctctaatgacttctccactagcattacagatgtatcacaaactttatctgttcctcaagcccaggttgaccctttagctgcagttgtcctccagaaccgccaaagccttgatttactcactgctgaaaaa

SEQ ID NO: 4063 - DNA, 2668 bp, Homo sapiens
aagaaaagtagaacggactaaaggtctaaacacacctcaccaagctcagccaccaacttaaaaagaactggacaatacttttaccactttcccttctcagaagtcagacctgtcctcagaatgctacaaggtacagtccatttaagctcctgtatagatgctcctttttattaggccccagtctcatcccagacaccagaccaacttagactgtgcccccaaaaaaacttgtcatccctactattttccgtctagtcatactcctattcaccgttctcaactactcatacatgccctgctcttgtttacactgccggtttacactgtttctccaagcacatcacagctgatatctcctggtgctatccccaaactgccactctaaactcttgaagtaaataaataatctttgctggcaggactatgctgaatctccttaggcactctctaatcagatgtcctaggtcctcccaattcttagaccttttatacctgtttttctccttcttccttgtatattccatttagtttctcaattcatacaaaaccgtatccaggccatcaccaatcattctatacgacaaatgtttcttctaacatccccacaatatcaccccttaccacaagacctcccttcagcttaatctctcccactctaggttcccacgctgcccctaatcccgcttgaagcagccctgagaaacatcgcccattctctctccataccaccccccaaaaattttcgccaccccaacacttcaacactattttatttttcttattaatataagaaggcaggcatgtcaggcctctgagcccaagccaagccatcgcaacccctgtgacttgcacctatacgcccagatggcctgaagtaactgaagaatcacaaaagaagtgaatatgccttgccccaccttaactgatgacattccaccacaaaagaagtgtaaatggccggtccttgccttaactgatgacattaccttgtgaaagtcctcttcctggctcatcctggctcaaaaagcacccccactgagcaccttgagacccccactcctgcccgccagagaacaaaccccctttgactgtaattttcctttacctacccaaatcctataaaacggccccacccttatctcccttcactgactctcttttcggactcagcccgcctgcacccaggtgaaataaacagctttattgctcacacaaagcctgtttggtggtctcttcacacggacgcacatgaaatttagttgtatccataaggcatatggaggagactaattcctcttccaaagacatgtaccagagtcctggagaggctgagggctggaggtggaagaaaggctctgacaggggtcagaatctgttcaggaaacatagcaaatgcctgatacttttaattagagaaaggtttgaatctccacattcatatatttgcagtccagtgacctttcagtttttttatgcccaaagtgtcaagcatgttaatgttaccattgactgcctccctgaaggtgcagctaccaggggaactgccaggacttcaaagcccacaaccaaaagccagaaaacactaccaagtacaagccccggacactggacccagagcacaccctgggcatctgctctgagatcctctccctggacagagacagctgctccttcagaaacagaggagaccctgaacacaggcaggcctcctgagcttccagccagggccacagccacatggttcagtgcctcccacactctcccagccttggctaccaggagggtggccagaactcagtggttgacagctgacagacagacgtgggcttccatatcgtccgtgccctgggctcagaccatcagtgagaaaaaacctggagggtctctctgggaaactcgttcttccccaccgactactgcagggaccgaggaagccatgaacactacaagccttttggcgcctgctgctgagataatggccacacctggcagcccatcccaggccagccctacctcgggagcattcacccatggcacacagactccgagtccaaccaaggcaacagcccccagatatccacaaacaggtgatctctctgcagagtggccattcactgctggtgaagagccagtcctggtcccaagaccccatcaagtttcaaggtgtcctcagccactcttcaaggtgggagctatggcagctgctcctctcaccctggctattcagaggctcaacccatgcctgatggagctgtgccaattcttccagcaatgcctctgcatgagccagaggagtcccaggacagaggacatgagatactgtcttgaatactattcctggtttctgaagaatgcaacatatatctgtcagagggtgaaaagggtgtcccactcgcacaccttaaagcaaaagtgccttgagaatatctgcaagtctgtgtgaggccttgaaaataacactagggcataacaattacttcaggggatacgccatccaccctggctcttgtcccaagtgggctacatttgaagaattcacccaggctccagctagatcatcagttaatttaaagtggttattcttggaagtagcattttttttccctctcctgtgaatctgtgcaaaacattgaaggtagaagttttcttgttaaaaaaaaaggaattc

SEQ ID NO: 4064 - DNA, 2205 bp, Homo sapiens
gcacgagggcggctatgccgtctggctctgctcgtcctgttgctcctggggcccggcggctggtgccttgcagaacccccacgcgacagcctgcgggaggaacttgtcatcaccccgctgccttccggggacgtagccgccacattccagttccgcacgcgctgggattcggagcttcagcgggaaggagtgtcccattacaggctctttcccaaagccctggggcagctgatctccaagtattctctacgggagctgcacctgtcattcacacaaggcttttggaggacccgatactgggggccacccttcctgcaggccccatcaggtgcagagctgtgggtctggttccaagacactgtcactgatgtggataaatcttggaaggagctcagtaatgtcctctcagggatcttctgcgcctctctcaacttcatcgactccaccaacacagtcactcccactgcctccttcaaacccctgggtctggccaatgacactgaccactactttctgcgctatgctgtgctgccgcgggaggtggtctgcaccgaaaacctcaccccctggaagaagctcttgccctgtagttccaaggcaggcctctctgtgctgctgaaggcagatcgcttgttccacaccagctaccactcccaggcagtgcatatccgccctgtttgcagaaatgcacgctgtactagcatctcctgggagctgaggcagaccctgtcagttgtatttgatgccttcatcacggggcagggaaagaaagactggtccctcttccggatgttctcccgaaccctcacggagccctgccccctggcttcagagagccgagtctatgtggacatcaccacctacaaccaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagttacatccactaccagcctgcccaggaccggctgcaaccccacctcctggagatgctgattcagctgccggccaactcagtcaccaaggtttccatccagtttgagcgggcgctgctgaagtggaccgagtacacgccagatcctaaccatggcttctatgtcagcccatctgtcctcagcgcccttgtgcccagcatggtagcagccaagccagtggactgggaagagagtcccctcttcaacagcctgttcccagtctctgatggctctaactactttgtgcggctctacacggagccgctgctggtgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccagcagctgcagctgccgtttctctctggggaggggagcccaagggctgtttctgccacttgctctcctcagagttggcttttgaaccaaagtgccctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaaaaaaaaaaaaaaaaaaaaaaaaaaaaaaaaaaaaaaaaaaa

SEQ ID NO: 4065 - DNA, 2397 bp, Homo sapiens
ttttttttttttttgaactaaatggtaaattttattactttaagaaagaagggaggaatggatattgagacagcaactagttctgtctgccacagtacatcagtcagtgtccagcaattatgttcaaatctatgtcacacagaatctacatattgaagaccatgtgttctgttcacaatgcaattaaactgaaaagataactaaaatattcataggatctacagttgtgacacatataagaatgaaatactcactgataaaaacaatcatagctataacatttataaggtttgtcccagtataacaggcatccagagttgggccagaaggctgtttccaggtgaccataacagggcttctctccaatatatgttctaaagtgagaaaggaggcatgaggggcaacaaacacttccctgagtcatttcattcatggagtttctggccattgtggattcgcttgtgcattataaggttagtgcttgtgctaaaggctttttcacactgaaaacatttataaggcttctctccagtgtgagttctcacgtgtaccctcaggcaagaggaattcctaaaggccttcccacattctttacactcataggttttctcaccagtgtgagttctcttgtgcacaataaggtaagagcctgtgctgaaggactttccacactggttacactcataaggcttctctccagtgtgagagcgtgtgtgtttcttaagggatgactgatcaatgaaggcttttccacagtcactgcattcatagggtttctctccagtgtgggttctcacatgtttctgaagggatgaaggaacagtgaaagccttcccacattccttacagtcatagggtttctctccagtgtgagttcttttgtgcacattcagatgagagctctggctaaaggattttccacagtgatcacactcataaggcttctctccagtatgagatctcatgtgtttcttaagggaagactgaaaaatgaaggctttcccacagtcactgcattcatagggcatctctccagagtgagttctgacacagttctgaagggacaaagggtcagtgaaagttttctcatgttcattacattccaaaccctcctccacactaccagtttttgtgtggacactaaggggagatattttgccatagtcactgcattcatcacctttctctccagtaggtatttgctcacgtactgagcaggaagagtgtaggctgaaggacatatcacattgctcatactcctgaaacttctgtcctgtgggagttcttaagtgtttcctgagggatgactcttgattgaaagcttttctacaatcagtaaattcaagagttttctctccaatgtgaatgctcacatgactcctaagagttgagggatggttgaagactttgctatactttatatatttatagcatttctctcccttgcaatatcttgtacaaataaagcgagtgttctttctgaatttcccacaatggttacactccagggagtgctcaccaggttgattttctgcctgttgaaaagggagtaagtggtgactagaggctttttcactttcaccttattcacaggaattctcttccatgaggattcatgtttatgccattggatgtttttcccccaggaatgttctgcatagcaattgtatcttttggtttaagttgagtttcccagtctgcacagtcaccttgtaaaattcctctttcatctgtcttcagctgttcttgatccaccttggagatcagactgtgtctgcagagctgataccctactgaggccaggttcctaaagttctccagcatcacatctttgtatagatttttttgagcagggtccagcaatccccactcctcctgggaaaagtccactgccacttcctggaaggttactgagttctgtgaccaggttgtcagccaccctgcagccattcttcctcctgtaggtttccttcctggctgggcagagtcctaagcaggcagagccatcaataattactttaaatataaatgtactcaggaggctgaggcaggaggatcacttgagagcaggagtttgagaccagcctaggcaacacagcaagaccgcatctctttgggtactagaagtatcataagcccccaagctgaatacataaaaagaaatccacatctaatttcattatagatttttcttccttggtatttgattttttcccataatttccaaaggagccaggggaaaaacacaggtcaccctgtatttcactccatccttggctaccttccccttgctcgtcagactcttctcccaggccctcttcttgcttacttatacccagcccgggacacgacagaattgtcaggttgctgaggccaggaggacaccaagcgaaggtc

SEQ ID NO: 4066 - DNA, 2110 bp, Homo sapiens
  misc_feature (1)...(2110): n = A,T,C or G
cttaaaccagccctagaagctgctcccacactagctctccctaactcatcncaacacttttcattacacacagccaatgtacagaactgtgtggttggaattcttacacaagagctgggaccacgccctgtagcctttctgtccaaacaacttgaccttactgttttagcctagccctcatgtctgcgtgcagcggctgccactgctttaatacttttagaggccctcaaaatcacaaactatgctcaactcactctctacagttctcataacttccaaaatctattttcttcctcatacctgacgcatatactttctgctccctggctccttcagctgtactcactctttgttgagtctcccacaattaccattgttcctggcccagacttcaatccggcctcccacattattcctgataccacacctgacccccatgactgtatctctctgatccacctgacattcaccccatttccccaaatttccttctttcctgttcctcaccctgatcacacttggtttattgatggcagttctaccaggcctaatcgccactcaccagcaaaggcaggctatgctatagtatcttccacatctatcattgaggctaccgctctgcccccctccactacctctcagcaagccgaactcattgccttcacccgagccctcactcttgcaaaaggactacgcatcaatatctatactgactcgaaatatgccttccatatcctgcaccaccgtgctgttatatgggctgaaagaggtttcctcactgtgcaagggtcctccatcattaatgcctctttaataaaaactctactcaaggccgctttacttccaaaggaagctggggtcattcactgcaagagggccatcaaaaggcatcagatcccattgctctaggcaacgcttgtgctgataaggtggctagacaagcagctagctctccaacttctgtccctcatggccagtttttctccttcacatcggtcactcccacctactcccctgctgacacttccacctatcagtctcttcccacacaaggcaaatggttcttagaccaaggaaaacatctccttccagcctcacaggcccattctattctgtcgtcatttcataacctcttccatgtaggttacaagccgctagcccgcctcttagaacctctcatttcctttccatcatggaaatctatcctcaaggaaataacttctcagtgttccatctgctattctactactcctcagggattattcaggccccctcccttccctacacatcaagctcaaggatttgccccacccaggactggcaaattagctttactcaacatgccctgagtcagaaaactaaaatacctcttagtctaagtagacactttcactggataggtagaggcctttcctacagggtctgagaaggccaccgcagtcatttcttcccttctgtcagacataattcctcagtttagccttcccacctctatacagtctgataacagaccagcctttattagtcaaatcagccaagcagtttttcaggctcttagtattcagtgaaacctttatatcccttacggtcctccgtcttcaagaaaagtagaatggactaaaggtcttttaaaaacacacctcaccaagctcagccaccaacttaaaaaggactggacaatacttttaccactttcccttctcagaattcaggcctgtcctcggaatgctacagggtacagcccatttaagctcctgtatagacgctcctttttattaggccccagtctcattccagacaccagaccaacttagactgtgccccaaaaaacttggtcatccctactatcttctgtctagtcatactcctattcaccgttctcaactactcatacatgccctgctcttgtttacactgccggtttacactgtttctccaagccatcacagctgatatctcctggtgctatccccaaactgccactcttaactcttaaagtaaacaaataatctttgctggcaggactatgctgaatctccttaggcactctctaatcagatatcctgagtcatcccaattcttagaccttttggacccatttttctccttn

SEQ ID NO: 4067 - DNA, 1839 bp, Homo sapiens
ttttttgaactaaatggtaaattttattactttaagaaagaagggaggaatggatattgagacagcaactagttctgtctgccacagtacatcagtcagtgtccagcaattatgttcaaatctatgtcacacagaatctacatattgaagaccatgtgttctgttcacaatgcaattaaactgaaaagataactaaaatattcataggatctacagttgtgacacatataagaatgaaatactcactgataaaaacaatcatagctataacatttataaggtttgtcccagtataacaggcatccagagttgggccagaaggctgtttccaggtgaccataacagggcttctctccaatatatgttctaaagtgagaaaggaggcatgaggggcaacaaacacttccctgagtcatttcattcatggagtttctggccattgtggattcgcttgtgcattataaggttagtgcttgtgctaaaggctttttcacactgaaaacatttataaggcttctctccagtgtgagttctcacgtgtaccctcaggcaagaggaattcctaaaggccttcccacattctttacactcataggttttctcaccagtgtgagttctcttgtgcacaataaggtaagagcctgtgctgaaggactttccacactggttacactcataaggcttctctccagtgtgagagcgtgtgtgtttcttaagggatgactgatcaatgaaggcttttccacagtcactgcattcatagggtttctctccagtgtgggttctcacatgtttctgaagggatgaaggaacagtgaaagccttcccacattccttacagtcatagggtttctctccagtgtgagttcttttgtgcacattcagatgagagctctggctaaaggattttccacagtgatcacactcataaggcttctctccagtatgagatctcatgtgtttcttaagggaagactgaaaaatgaaggctttcccacagtcactgcattcatagggcatctctccagagtgagttctgacacagttcatgtttatgccattggatgtttttcccccaggaatgttctgcatagcaattgtatcttttggtttaagttgagtttcccagtctgcacagtcaccttgtaaaattcctctttcatctgtcttcagctgttcttgatccaccttggagatcagactgtgtctgcagagctgataccctactgaggccaggttcctaaagttctccagcatcacatctttgtatagatttttttgagcagggtccagcaatgcccactcctcctgggaaaagtccactgccacttcctggaaggttactgagttctgtgaccaggttgtcagccaccctgcagccattcttcctcctgtaggtttccttcctggctgggcagagtcctaagcaggcagagccatcaataattactttaaatataaatgtactcaggaggctgaggcaggaggatcacttgagagcaggagtttgagaccagcctaggcaacacagcaagaccgcatctctttgggtactagaagtatcataagcccccaagctgaatacataaaaagaaatccacatctaatttcattatagatttttcttccttggtatttgattttttcccataatttccaaaggacccaggggaaaaacacaggtcaccctgtatttcactccatccttggctaccttccccttgctcgtcagactcttctcccaggccctcttcttgcttacttatacccagccctggacctggcctgctgggacagcaaccctttctcagctgcaggcgacagctatgggagatggcg

SEQ ID NO: 4068 - DNA, 1236 bp, Homo sapiens
cacggacgccgagcttcaggtaagtctcacagtggaaggtaagcccgtccccttcttaatcaatatggaggctacccactccacattaccttcttttcaagggcctgtttccctcaaaccccacaacaggacttaattaacctcaccttcaaggtgtacaataataaaaaaaaaagttgcaattccttcccagatcttctcggctcagcggctgaagactgacgctgcccgatcgcctcggaagccccctggaccatcacggacgccgagctttgggtaactctcacagtggaaggtaagcccgtccccttcttaatcaatacggaggctacccactccacattaccttcttttcaagggcctgtttcccttgcctccataactgttgtgggtattgacggccaggcttctaaacctcttaaaactccccaactctggtgccaacttagacaatactcttttaagcactcctttttagttatccccatctgcccagttcccttattaggctgagacactttaactaaattatctgcttccctgactattcctggactacagctgtatctcattgccacccttcttcccaatccaaagcctcctttgcgtcctcctcttgtatccccccaccttaacccacaagtataagatacctctactccctccttggcgaccgatcatgcaccccttaccatctcattaaaacctaatcacccttaccccactcaatgccaatatcccattcccgcagcacgctttaaaaagattaaagcctgttatcattcgcctgttacagcatggccttttaaaccctataaactctccttacaattcccccatttttcctgtcctaaaaccagacaagccttacaagttagttcaggatctgcgccttatcaaccaaattgttttgcctatccaccccgtggtgccaaacccatatactctcctatcctcaatacctgcctctactacccattattctgttctagatctcagacatgctttctttactattcctttgcacccttcatcccagcctctctttgctttcacttggactgaccctgacacccatcaagctcagcaaattacctaggctgtactgccgcaaagctttcacagacagcccccattacttccaatcaagcccaaatttcttcttcatctgttacctatctcggcataattctcataaaagcacacgtgctctccctgccaatcgtgtccgactgg

SEQ ID NO: 4069 - DNA, 1624 bp, Homo sapiens
  misc_feature (1)...(1624): n = A,T,C or G
ccccatttttcctgtcctaaaacgagacaagccttacaagttagttcaggatctgcgccttatcaaccaaattgttttgcctatccaccccgtggtgccaaacccatatactctcctatcctcaatacctccctctactacccattattctgttctggatctcagacatgctttctttactattgctttgcacccttcatcccagcctctctttgccttcacttagactgaccctgacacccattaggctcaacaaattacctgggctgcactgccacaaggcttcacagacagcccccattacttcagtgaagcccaaatttcatcctcatctgttagtcatactcccgttcaccgttctcaactactcatacatgccctgctcttctttacactgccggtttacactgtttctccaagacatcacagctgatatctcctggtgctatccccaaactgccactctaaactcttgaagtaaataaataatctttgctggcagaattctgtgaatctcctaggcactctctattcagatatctaagttcctccaattcttagacctntaatacctgtttttctccttctgttatcccattaagtttctcaattcatccaaaacggtatccagcccatcaccaatcattctatatgacaaatgtttcttctacatccccncaaatatcaccctttacacaaagacctccnttcagcttaatctctcccactctaggttcccacgctgcccctaatcccacntgaagcagccctgagaaacatgcccattctctctccctaccacccctcaaaaattttcaccaccccaacacttcaacactattttgttttatttttcttattaatataagaaggcaggaatgtcaggcctctgagcccaagccaagccatcgcattccctgtgacttgcacgtatacgcccagatggcctgaagtaactgaagaatcacaaaagaagtgaaaaggtcctgccccaccttaactgatgatattccaccattgtgatttgttcctgccccaccttaactgagtgattaaccctgtgaattgttctcctggctcagaagctccccaactgagcaccttgtgacccccacccctgcccaccagagaacaacccccttttactgtaattttcctttaccaacccaaatcctataaaatggccccaccccatctcccttcgctgactctctttttggactcagcccgcctgcacccaggtgaaataaacagccatgttgctcacacaaagcctgtttggtggtctcttcacacggacgcgcatgaaatttggtgccgtgactcggatcgggggacctcccttgggagatcaatcccctgtcctcctgctctttgctccgtgagaaagatccacctacgacctcaggtcctcagaccaaccagcccaagaaacatctcaccaatttcaaatccggtaagcggctctttttactctcttctccaacctccntcactatccttcaacctctttctcctttcaatcttggcgccacaattcaatctctcccttctcttaatttcaattcctttcattttctggtagagacaaaggagacacgttttatccgtggacccaaaactc

SEQ ID NO: 4070 - DNA, 1178 bp, Homo sapiens
  misc_feature (1)...(1178): n = A,T,C or G
acnaagctnagcctccaacttaaaaaggactgganagtacttttaccacttgcccttctcagaattagggcctgtccttgagaagccacagggtacaacccatttgaattttatatggatgcaccttcttactcagccacaatcttgttccagacancnnagccctgggcaactatcttccagtcctctagcaggctagacaggaaatttgccaagctgctaatcttctcttgcctactccagattcccagccatatgaagacaccctagctggacgatcagtccttgtcaaaagtctgacccctcaaactctacagcctcaatggaccagaccctacccggttatttatagcacaccaactgccgtccatctgcaggaccctctccattgggttcaccattccagaataaagccatgcccatcagacagccagcttgatctctcctcttcctcctggaagccacaagattaggccgagagccgatcagacaaacaacctacaacccttaagctcctggcagcgccagccaaggccatgcttccatgcaacactccttccaaatggccatcccagcatgcttccaagcaggcttcatccgttcctctggaccctcatctcttaagacctgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagtatgttgtttgttgttagagggcttgggacatttcactctttgccagcctcagcttaatccaggagacaaagattattttccttattatctcttctgcataggatctgcaatcagaactattgaacttctccattcagaccgccactcacacctatgggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgaaaaaaaaaaaaaaaaaaa

SEQ ID NO: 4071 - DNA, 443 bp, Homo sapiens
atgccctgctcttgtttacactgctggtttacactgtttctccaagccatcacagctgatatctcctgggctatccccaaaccaccactctttactccctcttggatttgttatatgatctttgccggcaggcacccctccaatactttcaccctgatgaagttctattctttacttttatactcactcttattctcattcccattcttatgccaccctttacctctccccagctatctccaccacactatcaatctcactgtctctctcctagccatttctaatccttctttaacaaacaattgctggctttgcatttctctttcctctaaaaccactgaggcctcaacttactcactgctgaaaaaggaggacttttcatatttctaaatgaagaatgttgtttttacctaaatcaatctggcctagtacctgacaacata

SEQ ID NO: 4072 - DNA, 1374 bp, Homo sapiens
tcccatcccacagcacgctttaaaaggattaaagcctgttatcactcgcctgctacagcatgggcttctaaaacctataaactctcctttcccttcctcccattttacctgtcctaaaaccagacaaggcttacaagttagttcaggatctgcgccttatcaaccaaattgttttgcctatccaccctgtggtgccaaacccatacactctcctatcctcaatacctccctctacaacccattattctgttctggatctcaaacatgctttctttactattcctttgcacccttcatcccagcctctctttgctttcacttggactgaccctgacacccatcaaggctcagcaaattacctagggctgtactgccgcaaaggtttcacaggacagcccccattacttcagtcaagcccaaatttcatcctcatctgttacctatctcggcataattctcataaaaacacacgtgctctccctgctgatcgtgtccgattaatctctcaaacctcagcacctttacaaaacaacaactcctttccttcctaggcatggttagtgcggtcagaattcttacacaagagccaggactgcaccctgtagcctttctgtccaaacaacttgaccttactgttttagcctagccctcatgtctgcgtgcagcggctgccgctgctttaatacttttagaggccctcaaaatcacaaactatgctcaactcactctctacatttctcataacttccaaaatctattttcttcctcatacctgacacatatactttctgttcccctggctccttcagctgtactcactctttgttaagtcccacaattaccattgttcctggcccagacttcagtccggcctcccacattattccggataccacacctgacccccatgactgtatctctctgatccacctgacattcaccccatttccgcatatttccttctttcctgttcctcaccctgatcacgcttgatttattgatggcagttccaccaggcctaatcgccacacaccagcaaaggcaggctatgctatagtacaagccactagcccgcctcttagaacctctcatttcctttccatcgtggaaatctatcctcaaggaaataacttctcagtgttccatctgctattctactactcctcagggattattcaggccccctcccttccctacacatcaagctcgaggatttgcccccacccaggactggcaaattagctttactcaacatgccccaagtcaggtaactaaaattttaatctctcccactctaggttcccacgccgcccctaatcccgctcgaagcagccctgagaaacatcgcccattctctctccatatcacccccca

SEQ ID NO: 4073 - DNA, 930 bp, Homo sapiens
  misc_feature (1)...(930): n = A,T,C or G
cctggtgactaggatgtcgtcggaggagaacaagtgcgtggagcagccgcagccaccaccccccgaggagcctggagccccggccccgagccccccagccgcagacaaaagacctcggggccggcctcgcaaggcgcttcccctttccagagagccagaaagaaactcagcccacctgcacccaggtgaaataaacagctttattgctcacacgaagcctgtttggtggtctcttcacacggacgcgcatgaaatttggtgccatgactcggatcgggggacctcccttgggagatcaatcccctgtcctcctgctctttgctccgtgagaaacatccgcctacgacctcaggtcctcagaccgaccagcccaagaaacatctcaccaatttcaaatccggagcttgctacatgtgccggaaatctggccactgggcagaggaatgcccgcagcctgggattcctcctaagccgcgtcccatctgtgtgggaccccactgaaaatcggactgttcaactcacctggcagccactcccagagcccctggaactctggcccaaggctctctgactgactccttcccagatcttctcggcttagcggctgaagactgacactgcccgatcgcctcggaagccccctagaccatcacgcacgccgagcttcgggtaactctcacaatggaaggcaggaacgtcaggcctctgagcccaagccaagccatcgcatcccctgtgacttgcacatatacacccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctnccccactgcaccttgtgacccccg

SEQ ID NO: 4074 - DNA, 725 bp, Homo sapiens
tccactacttctcagcaagtcaaactcattgccttaactcaagccctcacccttgcaaaggactacgtgtcaaatatttatactgactctaataatgcctcccatatcttgcaccaccatactgttatatgggctaaaagaggtttcctcactacgcaagggtcctccatcattaatgcctctttaataaaaactcttctcaaggccactttacttccaaaggaagctggattcattcactgcaagggccatcaaaaggcgtcagatcccatcgctcagggcaacacttatgctgataaggtagctaaaaaagcagctagcattccaacttctgtcccctcatggccaagtttttctccttctccatcggtcactcccaccctactcccccactgaaacttccaccttatcaatctcttcccacacaaggcaaatggttcttagaccaaggaaaatatctccttccagcctcacaggcccattctattctgtcatcatttcatagcctcttccatgtaggttacaagccgctagcccacctcttagaacctctcatttcctttcccatcatgaaaatctatcctcaaggaaatcacttctcagtgttccgtctgctattctactcctcctcagggattgttcaggccccctcccagtcctcccatttcattaccacttggctagccctgtgattattaaattctttctttgctgccaaaaaaaaa

SEQ ID NO: 4075 - DNA, 570 bp, Homo sapiens
  misc_feature (1)...(570): n = A,T,C or G
cgaggtgttcnactcacntggcagccactcccagagcccctggaactctggcccaaggctctctgactgactccttctcggcttagcggctgaagactgttgctgcccgatcgcctcggaagcnccgtagaccatcacggacgccgagcttccagtaactcacagtgaaagcttgtttaatgaagctagcttcaatgctgtgagctgctctatagacgcccatgtaggaggaaactcaaggggcccccagccactagccattgaggaactgaggccctcaatccaacaacccacaaggaactgaatcctgccaacaaccactgagtgagcctggaagcggatcctgcccagctgaaactcgagaagattgtagctctgctgccctgaccactattctaactgcacccttgagagagaccctcagccagctaatctgtacctggattcctaacctggagaaactgaaatagcaacgcatgttgatgtaagtgctaagtttgggagtaatttgttatgtaacaataaataactaataatacttattatttaggcaataaaaacatagaaaat

SEQ ID NO: 4076 - DNA, 867 bp, Homo sapiens
  misc_feature (1)...(867): n = A,T,C or G
cacggatgcatgtnacatttggtgctgaagacccaggacaggaggactcctttgggagaccagtgccctgttgtcgccctcactccgtgaggagatccacctatgatctcaggtcctcagaccaaccagcccaaggaacatcttgccaatttcaaatcggataggagtgtcaggcctctgagtccaagctaagccatcaaatcccctgtgacctgcacgtgtacatccagatgacctgaagcaactgaagatccacaaaagaagtgaaagtagccttaactgatgacattccaccattgtgatttgttcctgccccacgctaactgataccatatattcttcccccgcccttgagaatgtactttgtacacctatcccaaacctataagaactaatgataatcctaccaccctttgctgactctctttttggactcagcccgcctgcacccaggtgaaataaacagccctgttgctcacacaaagcctgtttaggtggtcttctatacggacatgcttgacacttggtgccaaaatctgggccagggggactccttcgtgagaccggccccctgtcctggccctcattccgtgaagagatccaccttgcagacctcgggtcctcagaccagcccaaggaacatctcaccaatttcaaatcggatctcctcggcttagtggctgaagactgatgctgcccgatcgcctcagaagccccttggaccatcacagatgccgagcttcgggtaactcttacggtcggaggattcccagccatattgaagacacccttagctgggacgatcagtcctttgtcaaaagtctgacccctcaaactctacagcctcaatgggaccagaccctacna

SEQ ID NO: 4077 - DNA, 440 bp, Homo sapiens
acctacgacttcgggtcctcagaccaaccagcccaaggaacatctcatgaatttcaaatcgggaccccactggaaatcggactgtccaacccggcagccactcccagggcccctagaactctggccaaaggctctctgactgactccttcccagatcttctcagcttagcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcgga

SEQ ID NO: 4078 - DNA, 893 bp, Homo sapiens
  misc_feature (1)...(893): n = A,T,C or G
ctgcacccaggtgaaataaacagctttactgctctcacacaaagcctgtttggtggtctcttcacacggacgcgcatgaaatttggtgctgtgactcggattgggggacctcccttgggagatcaatcccccgtcctcctgctctttgctccgtgagaaagatccacctacgacctcaggtcctcagaccgaccagcccaagaaacatctcaccaatttcaaatccgccactcccagagcccctggaactctggcccaaggctctctgactgactccttcccagatcttctcggcttagcggctgaagactgacaccgcccgatcgcctcggttgaagccccctagaccatcacggatgccgagcttcgggtaactctcacagtggaaggttcccacgccgcccctaatcccgctcgaagcagccctgagaaacatcgcccattctctctccatatcaccccccaaaaatttttgccaccccaacacttcaacactattttgttttatttttcttattaatataagacggcaggaatgtcaggcctctgagcccaagccaagccatcgcatcccctgtgacttgcacgtatatgcccagatggcctgaagtaactgaagaatcacaaaagaagtgaatatgctctgccccaccttaactgatgaccttccaccacaaaagaagtgtaaatggccggtccttgctttaagtggtgacattaccttgtgaaagtccttttcctggctcatcctggctcaaaaatcacccccactgagcaccttgcaacccccactcctgcctgccagagaacaaaccctctttgactgtaattntcctttacctacccaaatcctataaaacggccccacccttatctcccttcgctgactctct

SEQ ID NO: 4079 - DNA, 857 bp, Homo sapiens
tggcctgttcctgccttaactgatggcattatcttgtgaggcatctcaccaatttcaaatctggtcttctcggcttagcggctgaagactgacactgcccgatcgcctcggaagccccctagaccatcacggatgccgagctttagtataagaagacaggaatgtcaggcctctgagcccaagctaagccatcatatcccctgtgacctgcacatacacatccacatggccggttcctgccttaactgatgacattccaccacaaaagaagtgaaaatggcctgttcctgccttaactgttgacattatcttgtgaaattccttctcctagctcatcctggctcaaaagctcccctactgagcaccttgtgacccctactcctgcccgccagagaacaacccccctttttcctttacctacccaaatcctataaaacagccccacccttatctcccttcactgactttcttttcggactcagcccgcctgcacccaggtgattaaaaagctttattgctcacacaaagcctgtttggtcgtctcttcacacggacacacatgacatttggtgccgaagagctgggacaggaggactccttcaggagaccagttcccttgtcctcgccctcactccatgaggagatccacctatgacctcgggtcctcagaccaaccagcccaaggaacatctcaccaatttcaaatcagccaaaatccacagtgatccacataatactcaggaatcacccagaagggatttctatctgaaaggagaaagaagctctggggcatgaatatacgttgtcttgtgaaaaaataaatcagtaattcatgtgtgtatattttatactcaaaa

SEQ ID NO: 4080 - DNA, 501 bp, Homo sapiens
acggagccgctgctgttgaacctgccgacaccggacttcagcatgccctacaacgtgatctgcctcacgtgcactgtggtggccgtgtgctacggctccttctacaatctcctcacccgaaccttccacatcgaggagccccgcacaggtggcctggccaagcggctggccaaccttatccggcgcgcccgaggtgtccccccactctgattcttgccctttccacgagctgcagctgccgtttctctctggggaggggagcccaagggctgtttctgccacttgctctcctcagagttggcttttgaaccaaagtgccctggaccaggtcagggcctacagctgtattggacagcacagaaaaagatttccatcaccacagaaaggtcggctggcagcactggccaaggtgatggggtgtgctacacagtgtatgtcactgtgtagtggatggagtttactgtttgtggaataaaaacggctgtttccgtgaaaaaaaaa

SEQ ID NO: 4081 - DNA, 531 bp, Homo sapiens
caacatgccctgagtcagataactaaaatacctcttagtctaggtagatactttcactggataggtagaggcctttcctacagggtctgagaaggccacggcagtcatttcttcccttctgtcagacacaattcctcagttaagccttcccacctcaatatagtctgataacagatgagcctttattagtcaaatcagccaaacagtttttcaagctcttagtattcagtgaaaccttcatatcccttacagtcctccatcttcaagaaaagtagaatggactgaagatcttttaaaaacacacctcaccaagctcagccaccaaaaaggactggactacacttttatcactttcccttctcagaattcaggcctgtcctcggaatgctgcaggtacagccatttaagctcctgtatagacgtccttttattaggcccagtctcattccagacaccagagcaacttggactgtgccccagaaaacttgtcatcctagtatcttctgtctagtcatactccattcacggtct

SEQ ID NO: 4082 - DNA, 575 bp, Homo sapiens
ctcggattggcggacctcccttgggagatcaatcccctgtcctcctgttctttgctccatgaaaaagatccacctatgacctcaggtcctcagacccaccagcccaaggaacatctcaccaattttaaatccgatcttctcagcttagcggctgaagactgacgctgcccgattgattgcctgggaagcctcctggaccatcacagacgccttgggtaactcttacagtggaggacaggaatgtcaggccggcctctgagcccaagcatgcatgtatacatccagatggcctgaggcaactgaagaaccacaaaagaagtgaaaatggctagttcctgccttaactgatgacattaccttgtgacattccttctccgggacagtgagtctccggagctccccactgagcaccttgtgacccccgcccctgcccgcaagagaacaaccccctttaactgtaattttccaccacctacccaaatcctaaaaaacggccccactcctatctcccttgctgactcctttttcggactcagccaacctgcacccaggtgattaaaaagctttatttctca

SEQ ID NO: 4083 - DNA, 391 bp, Homo sapiens
  misc_feature (1)...(391): n = A,T,C or G
caacccggcagccccactccccaggcccctagtaactcntgccaaaggctctctgactgactccttcccagatcttcctcagttagcagctgaagactgatgctgcctgatcgccttggaagccccctggaccattacggatgctgcgctttggataactcttacagtagaggttccacctggcctaatcgccattcaccagcaaagattcccaactatatgaagacaccctagctggacgatcagttcttattaagaacctgacccctcaaactctacaacctcgatggactggaccctacttagtcatctatagtaccccaactgccgtccgcctgcaggatcctgcccactgggttcaccgttccagaataaagctgtgcccatcgga

SEQ ID NO: 4084 - DNA, 503 bp, Homo sapiens
tgctgcttattgagtgatgaagagcaacatattagctactgagatattttgcagaaaaaggaagagatgtcttcagctcaaatgctatcaaactggtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcaggtcctcagaccaaccagcccaaggaacatctcatgaatttcaaatcggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaaaccgtgcccatccgaaaaaaaaaaaaa

SEQ ID NO: 4085 - DNA, 582 bp, Homo sapiens
atctcaccaatttcaaatctgatctattcggcttagcgactgaagattgacgctgcccgatcgcctcggaagtcccctggaccatcacagaagccgagcttcgggtaactctcacagtggagggtaagtccatcccctgtttaatcgatacgggggctacccactccacgttgccttcttttcaagggcctgtttcccttgcccccataactgttgtgggtattgacggccaagcttcaaaacccctgaaaactcccccactctggtgccaacttggacaacactcttttatgcactcttttttagttatccccacctgcccacttcccttattagggccgaaatattttaaccaaattatctgcttccctgactattcctggagtacagctacatctcattgctgcccttctttcccaatccaaagcctcctttgtgtcctctaacatccccacaatatcaccccttaccacaagacctcccttcagcttaatctctcccactctaggttcccacgccgcccctaatcccacttgaagcagccctgagaaacatcgtccattctctctccataccaccccc

SEQ ID NO: 4086 - DNA, 501 bp, Homo sapiens
tcatcagcagcacagtgcttcctttcctctgaatctgccatcagctcaggcagatttctaagcagcaaatcagcctttgccagaacactgcaggacaccagtgcagcgcccagcctgcgaccatgagctcgcctgcacccaggtgattaaaaagctttattgctcacacaaagcctgtttggtggtctcttcacatggacgcgagtgacatttggtgccgtgactcggatcggggaacctcccttgggagatcaatcccctgtcctcctgctctttgttccaagagaaagatccacctacgacctctgctcctcagaccaaccagcccaaggaacatctcaccaattttaaatcgggctctaggggatggtagagtcacaggatggaagaactctgtgtccttgaatcattgcatggaagagaactggaagttgcccaggaacaccagccttggacagttatgtgaacaagaaataaacttcttttacagtgtcaaaaaaa

SEQ ID NO: 4087 - DNA, 551 bp, Homo sapiens
gttctgcatagcaattgtatcttttggtttaagttgagtttcccagtctgaaatagcacaggaatttttataattattgggagaaaaggttgggatcaaagaaaaagggagggagaccctatggatttgttttcaaataatatcttctaagtagagaaatgtaagaaagaagacacaaccagtgattcaccagtgataggaacaagcagtagaaatgggaggtattttagttagaaaggattgtggaggttgggaaataagacagtattatctggaaaatagggagaactaaacaaaaagcattcatggagacattacatttaaagaggaattaaaacttctttctcggagaccaaatgaacgtatgaatgattgaatagatggtgaaacaggaaggaagctcatgtcatggcctcagatttcttttccttcactgagtaacattcccaaggctcacctgcacagtcaccttgtaaaattcctctttcatctgtcttcagctgttcttgatccaccttggagatcagactgtgtctgcagagctgataccc

SEQ ID NO: 4088 - DNA, 433 bp, Homo sapiens
  misc_feature (1)...(433): n = A,T,C or G
accataccctcttttcaagggcctgttccccttgcctccataactgttgtgggtattgaagccaggcttctaaacctcttaaaactcccaactnctggtgccaacttagacaacattcttttaagcactcttttttagttatctccaccggcccacttcccttattaggccgagatattttaaccaaattatctgtttccctgactattcttggactacagcggcatttcattggggccctttttcccaatccaaagcctcctttgggtcctccttttgtattccccccccttaacccacaagtataagagacctttactccctccttggtgactgatcacgcaccccttaccttttcattaaaattgaatcaaccctgacccctttccttcataaaaaaaaaaaaaaaaaaaaaaaaaaaaaaaaaaaaaaa

SEQ ID NO: 4089 - DNA, 459 bp, Homo sapiens
aatctattttcttcctcatacctgacgcatatactttatgctccccggctccttcagctgtactcactctttgttaagtcccacaattaccattgttcctggcccagacttcaatctggcctcccacattattcctgaagtaactgaagaatcacaaaagaactgaaaagggcccctgccccgccttaactgatgacattccaccatggtgatttgttcttgccccaccttaactgagtgattaaccctgtgaatttgcttctcctggctcagaagctcccccactgagcaccttgtgacccccgcccctgcccaccagagaacagacccctttgactgtaattttccattaccttcccaaatcctataaaacggccccacccctatctcccttcactgactctcttttcggactcagcccgcctgcccccaggtgaaataaacaaccatattgctcac

SEQ ID NO: 4090 - DNA, 761 bp, Homo sapiens
acacaaagcctgtttggtggtctcttcacactgacgtgcatgaaatttggtgctgtgactcggatcgggggacctcccttgggagatcaatcccctgtcctcctgctctttgctccatgagaaagatccacctacgacctcaggtcctcagaccgaccagcccaaggacaacgagacattagaggtgcacccacccccgaccactacatatcaggacgtcatcctaggcactcggaagacctatgccatctatgacttgcttgacaccgccatgatcaacaactctcgaaacctcaacatccagctcaagtggaagagacccccagagaatgaggcccccccagtgcccttcctgcatgcccagcggtacgtgagtggctatgggctgcagaagggggagctgagcacactgctgtacaacacccacccataccgggccttcccggtgctgctgctggacaccgtaccctggtatctgcggctgtatgtgcacaccctcaccatcacctccaagggcaaggagaacaaaccaagtgaggacctgagtcctgaaccaggcccccagcccgccctctcatgtcctctccaggtcccccaaactctcatttcccagggtagttcctgaagtacctctgaaaagctacacaggcataaagagtaaggaatagtttctcaaaactggaacgggagcctcactgtgccaggttcagaagtaatttataaaacagcaataattaaaacacataatactggtgattctt

SEQ ID NO: 4091 - DNA, 474 bp, Homo sapiens
  misc_feature (1)...(474): n = A,T,C or G
catccctactatcttctgtctagtcatactcctattcaccattctcaactactcatgcattccctgctcttgtttacactgccggtttacactacttctccaagccatcacagctgatatttcctggtgctatccccaaactgccactcttaactcttgaagtaaataaataatctttgctggcaaggctatgctgaatctccttaggcactctaattagatgtcctaggtcctcccaattcttagacctttaatacctgtttttctccttctcttattccgtttagtttttcaattcatacaaaaccgtatccaggccatcancaataattctaaatgacaaatgtttctgctaatagtccacaatatcacccttancacanaatcttcctcagctaatctctccactctaggttccacgcggcntaatccgttgaagagcctgagaacacgccatattttcaaacanccaaa

SEQ ID NO: 4092 - DNA, 654 bp, Homo sapiens
  misc_feature (1)...(654): n = A,T,C or G
aggttaagtggaaggtnaaggaatccttaaaanaaagagccaagggactggaaccctggtaggcctttctggtcnaaggaaaacttggaccttaactggttttaagcctagccctcaatggtctgcggtngagcgggtgccgctgctttaatacttttagaggccctcaaaatcacaaactatgctcaactcactctctacagttctcataacttccaaaatctattttcttcctcatacctgacgcacatactttctgcctccccaggctccttcagctgtactcactctttgtggagtctcccacaattaccgttgttcccggcccagacttcaatccggcctcccacattattcctgataccacacctgacccccatgactgtatctctctgatccacctgacattcaccccatttccccaaatttcctggtttcccgttcctcaccctgatcacgcttgatttatagatggcggttccaccaggcctaatcgccacacaccagcaaaggcaggttatgctatagtacaagcaactagcccgcctcttagaaccactcatatcctttccatcatggaaatctatcactcaaggcaataacatctcagagatccatttgctatactactacatccacagggaatatacaggc

SEQ ID NO: 4093 - DNA, 473 bp, Homo sapiens
cccaaggaacatctcaccaatttaaaatccgatcttctcagcttagcggctgaagactgacgctgcccgattgattgcctgggaagcctcctggaccatcacagacgccttgggtaactcttacagtggaggacaggaatgtcaggccggcctctgagcccaagcatgcatgtatacatccagatggcctgaggcaactgaagaaccacaaaagaagtgaaaatggctagttcctgccttaactgatgacattaccttgtgacattccttctccgggacagtgagtctccggagctccccactgagcaccttgtgacccccgcccctgcccgcaagagaacaaccccctttaactgtaattttccaccacctacccaaatcctaaaaaacggccccactcctatctcccttgctgactcctttttcggactcagccaacctgcacccaggtgattaaaaagctttataactca

SEQ ID NO: 4094 - DNA, 624 bp, Homo sapiens
  misc_feature (1)...(624): n = A,T,C or G
aggtcattctcaggttttatatatatatactttcagaaatcaaaaacaaaattctgagacctcccaaccatctgaaaggacacctcctctagccaaggcattccaaagttaagctgaaaaactgtttcagtgctgtgatggaagtgggggtcagacatgcctcattatgccctcctcttttttggaattcaggaagaccgaccggcactaacatcaacacagacctaaggcctgataagaaacatttgccatatctttcctgttcctcaccctgatcacgcttgatttattgatggcagttccaccaggcctaatcgccacacaccagcaaaggcaggctatgctatagtacaagccactagcccgcctctcagaacctctcgtttcctttccatcgtggaaatctatcctcaaggaaataacttctcagtgttccatctgctattctactactcctcagggattcttcagggccccctccctttcccttacacattcaaggttcagggggttttgcccccacccggggnttgggcaaattaggcttttanttnaacgtggccctgaggccaggggggnaccaaaataaattttttggggttagggnagggacatttttcattg

SEQ ID NO: 4095 - DNA, 500 bp, Homo sapiens
ctcggattggcggacctcccttgggagatcaatcccctgtcctcctgttctttgctccatgaaaaagatccacctatgacctcaggtcctcagacccaccagcccaaggaacatctcaccaattttaaatccgatcttctcagcttagcggctgaagactgacgctgcccgattgattgcctgggaagcctcctggaccatcacagacgccttgggtaactcttacagtggaggacaggaatgtcaggccggcctctgagcccaagcatgcatgtatacatccagatggcctgaggaactgaagaaccacaaaagaagtgaaaatggctagttcctgccttaactgatgacattaccttgtgacattccttctccgggacagtgagtctccggagctccccactgagcaccttgtgacccccgcccctgcccgcaagagaacaaccccctttaactgtaattttccaccacctacccaaatcctaaaaaacggccccact

SEQ ID NO: 4096 - DNA, 448 bp, Homo sapiens
  misc_feature (1)...(448): n = A,T,C or G
ccgccatttttcccaatccaaagcctcctttgcatcctcctcttgtatccccccaccttaacccacaagtataagatacctctactccctccttggtgaccgatcatgcaccccttaccatctcattaaaacctaatcacccttaccccactgaatgccaatatcccatcccgcagcacgctttaaaaagattaaagcctgttatcactcgcctgctacagcatggccttttaaagcctataaactctccttacaattcccccattttacctgtcctaaaaccagacaagccttacaagttagttcaggatctatgcttatcaaccaaattgttttgctatccacctgtgtgccaaacccgtatactttctatccncaatacctccctcaaaacccattatctgtctagattcaacatgcttcctatatccttggaccttatncagct

SEQ ID NO: 4097 - DNA, 442 bp, Homo sapiens
  misc_feature (1)...(442): n = A,T,C or G
cccccaacctcattttagtggcntaagcatngcctggccttcctgtctagtctctcctggtaagccaangaaatgaacatttccaaggagttgggaagtgaagtctatgatgtgaaacactttgcctcctgtgtactgtgtcataaacagatgaataaactgaatttgtactttaaaaaaaaaaaaaaaaaaaaaaactcgccccatttccccatatttccttctttcctgttcctcaccctgatcacgcttgatttatggcagttccaccaggcctaatcgccacacaccagcaaagtcaggctatgctatagtacaagccactagcccgcctctcagaacctctcatttcctttccatcctggaaatctatcctcaaggaaataacttctcagtgtnccatctgctattntactactcctcagggattattcaggccccc

SEQ ID NO: 4098 - DNA, 441 bp, Homo sapiens
ggcacgaggtgccgcctataaaaaggattatatcttgagaccctatcctctaaaattttttccacacccaaaacaaaaaatctctgggtcaaaagtctaaaacgcttaggctggcaaccatcagatccttgcccatggtgtcctcaagcctactctcatgaaatggacaacagtacacgcatatggggccagttccacatatttggcaaccagaccagcatccaggacaacacaaagatctgcaatcagaactattgaacttctccattcagaccgccactcacaccttggggaaaagggtaatgtatcatcggcttagcaacagggaatactattcgtatgatggaaaatggggacaaaaggctttggtacataaaacattattccttccttggcctaaaaactcatcgccacctacattaaagctaatatgcctgaaaa

SEQ ID NO: 4099 - DNA, 470 bp, Homo sapiens
  misc_feature (1)...(470): n = A,T,C or G
tcacattgctcatactcctgaaacttctgtcctgtgggagttcttaagtgtttcctgagggatgactcttgattgaaagcttttctacaatcagtaaattcaagagttttctctccaatgtgaatgctcacatgactcctaagagttgagggatggttgaagactttgctatactttatatatttatagcatttctctcccttgcaatatcttgtacaaataaagcgagtgttctttctgaatttcccacaatggttacactccagggagtgctcaccaggttgattttctgcctgttgaaaagggagtaagtggtgactagaggctttttcactttcaccttattcacaggaattctcttccatgaggattctgccatatataggaagcacatgatcatgactgacatgtgtaccattnanngtaggtgcgtatgacttttgccctatctagctttttcgagntgaata

SEQ ID NO: 4100 - DNA, 413 bp, Homo sapiens
  misc_feature (1)...(413): n = A,T,C or G
ctgcactgccacaaggcttcacagacagcccccattacttcagtgaagcccaaatttcatcctcatctgttagtcatactcccgttcaccgttctcaactactcatacatgccctgctcttctttacactgccggtttacactgtttctccaagacatcacagctgatatctcctggtgctatccccaaactgccactctaaactcttgaagtaaataantaatctttgctggcaggactctgntgaaatctccttaaggcactcttctaatcaggatatccctaagggcgtcccaatttcttaagaccttttaatanccctggttttcntccttcctggttaattccaattaaggtttcccaaantcaatcccaaaaccgggaatcccaggggcaatnaaccnattaagttc

SEQ ID NO: 4101 - DNA, 485 bp, Homo sapiens
cccaaggaacatctcaccaatttcagatcggatcttctcagcttagcggctgaagactgacgctgcccgattgattgcctgggaagcctcctggaccatcacagacgccttgggtaactcttacagtggaggacaggaatgtcaggccggcctctgagcccaagcatgcatgtatacatccagatggcctgaggcaactgaagaaccacaaaagaagtgaaaatggctagttcctgccttaactgatgacattaccttgtgacattccttctccgggacagtgagtctccggagctccccactgagcaccttgtgacccccgcccctgcccgcaagagaacaaccccctttaactgtaattttccaccacctacccaaatcctaaaaaacggccccactcctatctccctttgctgactcctttttcggactcagccaacctgcacccaggtgattaaaaagctttatttctcaaaaaaaaaaaa

SEQ ID NO: 4102 - DNA, 400 bp, Homo sapiens
  misc_feature (1)...(400): n = A,T,C or G
ccccaataaattaaccggtggatcctgggcccaaggacttaaaaantggccctcccacattattcctgataccacacctgacccccatgactgtatctctctgatccacctgacattcaccccatttcccnaaatttccttattttctgttcctcaccctgatcacgcttgatttattgatggcggttccaccaggcctaatcgccacacaccaggaaaggcaggttatgctatagtacaagccactagcctgcctcatagaacctctcatttcctttccgtcgtggaaatctatcctcaaggaaataacttctcagtgttccatctgctattctactactcctcagggattattcaggccccctcccttccccaaaaagctcgaaatagggcaaggttc

SEQ ID NO: 4103 - DNA, 372 bp, Homo sapiens
aattcaggcctgtcctcagaatgcttacaaggtacagcccatttaagctcctgtatagatgctcctttttattaggccccagtctcattccagacacttggaccaacttagactgtgcccccaaaaaaacttgtcatccctactattttctgtctagtcatattcctattctccattctcaactactcacacatgccctgctcttgttcacactgccagtttacactgtttctccaagccatcacagctgatatctcctcgtgctatccccaaactgccactcttaactcttgaagtaaataaataatctttgctgggaggacctaggacatctgattagagagtgcctaaggagattcagcatagtcctgc

SEQ ID NO: 4104 - DNA, 616 bp, Homo sapiens
  misc_feature (1)...(616): n = A,T,C or G
ggacggcatgaaatttggtgctgtgactcggattgggggacctcccttgggagatcaatcccctgtcctcctgttctttgctccatgagaaagatccacctacgacctcaggtcctcagaccgaccagcccaagaaacatctcaccaatttcaaatccgatcttctcggcttagcggctgaagactgacaccggccgatcgcctcggaagccccctagaccatcacggatgccgagcttcgggtaactctaacagtggaagaggccaggctaacagggactgctgatggggaaataaagaaataatcaaggatgaatcctatatctggggttgagcaaagagtctatcatctacgtagaactgaagatgacagaagacaccaaaggaggacgggggcttccaggaagagccagtaagatgtgctgagtaggaagatgtgaagaaaattgttgaacacgtctgacaatagaagaccnaaggctaagaagtccatttcatgaatcacaaagaaatcaagaacagaatttctctcttttgaagagagatattgcttattaagtcacgcagagattctgaccatgtntgtccctgtcaactgtgncctcatgngtgtgat

SEQ ID NO: 4105 - DNA, 436 bp, Homo sapiens
gaacggcgcacgataggctgtattgggaccggggcccaaaatcgaggatttgcccccacccatggactggcaaattagctttactcaacatgccccgagtaagataactaaaacacctcttagtctaggtagacactttcactggataagtagagtcctttcctacagggtctgagaaggccaccacagtcatttcttcccttctgtcagacataattcttcagtttagccttatcattcccttctgtcagacgtaattcctcaaatttagccttcccacctcttatacagtctgattaacagaccagccctttatttgtcaaatcaggccaagcattttttcaggctcttaggtatttcagtgaccaggcttaaaacacaaccttaacccaaccttcaggccacccaactttaaaaaggggccttgggccaaata

SEQ ID NO: 4106 - DNA, 312 bp, Homo sapiens
  misc_feature (1)...(312): n = A,T,C or G
aaattatctgcttccctgactattcctggaccatagccgcatctnattgatgcccttcttcccaatccaaagcctctttngcgtcctcctcttgtattcccccatcttaaccnacaagtataagatacctntactccctccttggcgaccgatcatgcaccccttaccatctcattaaaacctaatcacccttacctggctcaatgccaatatcccatcccacagcatgctttgaaaggattaaagccttgtttaacacttgccttcactttaggacttnaccctggacacccatttaggctcagcaaaatt

SEQ ID NO: 4107 - DNA, 496 bp, Homo sapiens
  misc_feature (1)...(496): n = A,T,C or G
gttttgctgcttattgagtgatgaagagcaacatattagctactgagatattttgcagaaaaaggaagagatgtcttcagctcaaatgctatcaaactggtgaaataaacagcgttgttgctcacacaaagcctgtttggtagtctcttcacatggacgcgtgtgacatttggtgctgaagacccgggacaggaggactccttcaggagacgggtcccctgtccttnngnccactccgtgaggagatccacctacgacctcagtcctcagaccaaccagcccaaggaacatctcatgaatttcaaatcggattcccaactatatgaagacaccctagctggacgatcagttcttattaagaacctgacccctcaaactctacaacctcgatggactggaccctacttagtcatctatagtaccccaactgccgtccgcctgcaggatcctncccactgggttcaccgttccagaataaagctgtgcccatcggaaa

SEQ ID NO: 4108 - DNA, 555 bp, Homo sapiens
  misc_feature (1)...(555): n = A,T,C or G
tnntttgaatnggggacctcccttgggagctcaatccctggtcttcctgttctttgctcggtgagaaagatccacctacgacttcaggtcntcagactgaccagcccaaggaacatctcacccaattttaaatcagaaggcaggaatgtcaggcctctgagccccaagccaagccatcgcatcccctgtgacttgcacctatacgcccagatggcctgaagtaactgaagaatcacaaaagaagtgaatatgccctgccccgccttaactgatgacattccaccacaaaagaagtgtaaatggcaggtccttgccttaagtgatgacattacctgtgaaagtccttttcctggctcatcctggctcgaaaacaccgccactgagcaccttgcgacccccactcctgcccgccagagaacaacccccctttgactgtaattttcctttacctacccaaatcctgtaaaatggccccacccctatctcccttcactgactctcttttcggactcagcccacctgcacccaggtgattaaaagctttattgctcacac

SEQ ID NO: 4109 - DNA, 458 bp, Homo sapiens
tgggggacctcccttgggagatcaatcccctgtcctcctgctctttgctctgtgagaacgatccacctatgacctcaggtcctcagactgaccagcccaagaaacatctcacgaatttcaaatctgatctgctcagcttagcgactgaagattaatgctgcctgatcacctcagaagccccctggaccatcacagatgcccaacttcaggtgactctcaagtggaggatcctataagatggccccacgcttatctccctttgctgactctcttttcggacttggcccacttgcaccaaggcctctgagcccaagccgagccatcgcatcccctgtgatttgaaggtatatgcccaggtggcctgaagtaaccgaagaatcgcaaaagaagtgaaaatgcgctgccccgccttaactgatgacattccaccacaaaataagtgcaaatgccagtccttg

SEQ ID NO: 4110 - DNA, 470 bp, Homo sapiens
  misc_feature (1)...(470): n = A,T,C or G
gccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaaacctcgaagtagggggaaaactgcagtggaagatgaggacagcatggatgggctggagacaacagaaacagaaacgattgtggaaacagcagaaatcaaagaacaatctgcagaagaggatgctgaagcagaagtggataacagcaaacagctaatttccaactcttcagcgatctgtgtctgaggaatcggcaaactccctggtctctgttggtgtagaagccaaattcagtgaacagctctgggcnttttggtactgt

SEQ ID NO: 4111 - DNA, 354 bp, Homo sapiens
  misc_feature (1)...(354): n = A,T,C or G
ccccctgnaaaccctggtgatgaatggtgaagctggaaaacctggaaaagctggaccaggtcagggcctacagctgtgttgtccagtacaggagccacgagccaaatgtggcatttgaatttgaattaacttanaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtantggatggagtttactgtttgtggaataaaaacggctgtttccg

SEQ ID NO: 4112 - DNA, 347 bp, Homo sapiens
  misc_feature (1)...(347): n = A,T,C or G
ctctcctcagagttggcttttgaaccaaagtgccctggaccaggtcagggcctacagctgtgtggttcagtacaagattaaatgtggcaatatgatgaggcagttgggaaacactcttgggttaaaaataaggtaaatcaggtagaattaactcaaatcgttgatggttataaagtttggcaaatgaggtttaatatttaatctcaaatactaaaatgactatatccacagccaggcgtggtggctcacacctgtaatcccggtactttggaaggntgaggtgggaggattccttgagttgtagatcagtgtggtcaacatagggagattctctttctcctgcncnn

SEQ ID NO: 4113 - DNA, 530 bp, Homo sapiens
  misc_feature (1)...(530): n = A,T,C or G
ccctcaaaataagtagaggcctttcctacagggtctgagaaggccaccgcagtcatttcttcccttctgtcagacataattcctcagtctngccttcccacctcaatacngtctgataacagacgagcctttattagtcaaatcagccaagcagtttttcaggctcttagtattcngtgaaacctttatatcccttatggtcctccatcttcangaaaacacacctcaccaagctcagccaccagcttaaaaaggactggacaatacttttaccactttcccttctcagaattcaggcctgtcctcggaatgctacaaggtgtacagcccatttaagctcctgtatagacgctcctttttattacgccccagtctcattccagacaccagagaacaaaccccctttgactgtaattttccattaccttccctaatcctataaaacggccccaccccatctccctttgctgactctcttttcggactcagcccgcctgcacccaggtgaaataaacagccttgttgctcac

SEQ ID NO: 4114 - DNA, 461 bp, Homo sapiens
cacggacgcgcatgaaatttggtgccgtgactcggatcgggggacctcccttgggagatcaatcccccatcctcctgctctttgctccatgagaaaaatccacctatgaccttaggtcctcagaccgaccagcccaagaaacatctcaccaatttcaaatccgatttaccggaacattccaggatttttacgtacacttatggatgccctgagaaaagacaaaataatctttcctaatgatgaaaatgttaaattcctttcttctcctcttctcatcttacatggagaggatgacaggacagtgcctttggagtatgggaaaaagggaaattggactagaaaaatctacagctttgaatggccatcctttgagtctctttctgtcgcttgcagctctatgaaattgcacgcaatgcatacaggaacaaagagagggtcaagatggttatctttcctcctgg

SEQ ID NO: 4115 - DNA, 568 bp, Homo sapiens
  misc_feature (1)...(568): n = A,T,C or G
caaaaagcactcccactgagcaccttgcgacccccactcctacccgccagagaacaaccccctttgactacgcgcatgaaatttggtgccgtgacttggatcgggggacctcccttgggagctcaatcccctgtcctcctgttctttgctcggtgagaaagatccacctacgacctcaggtcctcagactgacccagccaaggaacatctcaccaattttaaatcagaaggcaggaatgtcaggctctgagccaaancaaggcatcgcatccccctgtgacttgcanctatacggccagatggcctgaagtaactgaagaatcacaaaaagaagtgaatatggcctngcccggcttaacttgatgacattccaccacaaaagaagtgtaaatggcaggtccttggcttaagtgatgacattacctgtgaaagtccttttcctggctcatcctgggctcgaaaacaccgccacttgngcaccttgcgacccccanttctggccgccagagaacaaaccccctttgactgtaattttcctttactacccaatcctgtaaatggnccaccc

SEQ ID NO: 4116 - DNA, 430 bp, Homo sapiens
  misc_feature (1)...(430): n = A,T,C or G
cggactcagcccacctgcacccaggtgattaaaagctttattgctcacacaaagcctgtttggtggtctcttcacacggacacacatgaaatttggtgccgtgactcggatcgggggtcctcccnttgggagaatcaatcccctgtcctcctgttctttgctccgtgagaaagatccacctacgacctcaggtcctcagaccgaccagcccaacgaacatctcaccaattttaaatcaggacctacccagtctgccctgctcatacttgatctggatgagactgataccctgcgaagaccgcaacagaatcagctcctgggattgtgttagcagaatgaccgggagtgtggagatccaccacatggcgaggcaacccangaacctgttttcttcttgaagagcaaccggggaactaatttccaaggttta

SEQ ID NO: 4117 - DNA, 560 bp, Homo sapiens
cacattatttatcacattatttattaagtttcttcagtcacaggccatctcacagaaagaaatcccccatgagaaacttttaggacatagcttttatgttaattacttaatttctgcactagccatccttgcctgccttctaattttctgcactagctatccttaccttccttctaattttctaacctgccaaggattctgctgcctcaaggtatttgtttctttctgcctggattgctctttcgcagatacttacatgtctcattctttttcacccaggtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcgggtaagcggtcttttccatcctctcttgctacccttcaatctccctctctcgctacccttcaatctccct

SEQ ID NO: 4118 - DNA, 338 bp, Homo sapiens
  misc_feature (1)...(338): n = A,T,C or G
natttgtcaaccacccagccaccatcctttcctcttcaaattttgactcatgaagacagaaaacatcttgagaaagatgatcgtcaatctttcagcaacaggcattactcatctgtcatcaagcgccattcattagccatctctctatactccaagccattcagaagactgaggcgggagcaacacctgagcccangggaggtcaatgctgcagtgaaccgtgatctcaccactgcactctgccgggacacgacagaattgtcaggttgctgaggccaggaggacaccaagcgaaggtcaccgtgaacaggaaggcagagatgctgttcctcagacgc

SEQ ID NO: 4119 - DNA, 404 bp, Homo sapiens
ctcagatccggggacttcccttgggagatcaatcccctgtcctcctgctctttgctctgtgaaaaagatccacctacgacctcaggtcctcagaccaagcagcccaaggaacatctcaccaattttaaatcgggccctgcactccatgggatcagctgacaccacacagaccagtcatctggcccaaccagttctgccatctcacccaggaacagaagacattaagaaaatctaacttcgaccctctatgattccatctccaacctgagcaatcagcactccccacttcccaagcccctacctgccaaattatctttaaaaactctgatccacgaaggctcaaggatttaagtaataataaaactccagtctcccgcaaaaaaataaaaaaaaaaaaaaaaaaa

SEQ ID NO: 4120 - DNA, 364 bp, Homo sapiens
cgggggacctcccctgggagatcaatcccctgtcctcctgctctttgctccatgagaaagatccacctacgacctcaggtcctcagaccaccagcccaagaaacatcacaccaatttcaaatccggaccccactggaaatcggactgtccaactcacctggcagccactcccagagcccctggaactctggcccaaggctctctgagtccttccccgatcttcttggctcagcggctgaagattgatactgcccgatcacctcggaagccccctagaccatcacggacgccgagctttgggtaactctcacagtggaagaagacaggaatgtcaggccgctgagcccaagctaagccatcatat

SEQ ID NO: 4121 - DNA, 392 bp, Homo sapiens
  misc_feature (1)...(392): n = A,T,C or G
caaaaagcactcccactgagcaccttgcgacccccactcctacccgccagagaacaaccccctttgactacgcgcatgaaatttggtgccgtgacttggatcgggggacctcccttgggagcntcaatcccctgtcctcctgttctttgctcggtgagaaagatccacctacgacctcaggtcctcagactgaccagcccaaggaacatctcaccaattttaaatcagaaggcaggaatgtcaggcctctgagcccaagccaagccatcgcatcccctgtgacttgcacctatacgcccagatggccttgaagtaacttgaagaatcacaaaagaagtgaatatgccctgccccgccttaactgaatgacattccaccacaaaagaagtgta

SEQ ID NO: 4122 - DNA, 386 bp, Homo sapiens
tgggggacctcccttgggagatcaatcccctgtcctcctgctctttgctctgtgagaacgatccacctatgacctcaggtcctcagactgaccagcccaagaaacatctcacgaatttcaaatctgatctgctcaacttagcgactgaagattaatgctgcctgatcacctcagaagccccctggaccatcacagatgcccaacttcaggtgactctcaagtggagggcctctgaacccaagccaagccatcgcatcccctgtgatttgaaggtatatgcccgggtggcctgaagtaaccgaagaatcgcaaaagaagtgaaaatgcgctgccccgccttaactgatgacattccaccacaaaataagtgcaaatgccagtccttg

SEQ ID NO: 4123 - DNA, 336 bp, Homo sapiens
caagctcagccaccaacttaaaaagcactggacaatacttttaccactttcccttctcagaattcaggcctgtcctcggaatgctacaaggtacagcccatttgagctcctttttattaggccccagtctcattccagacaccagacgaacttaaactgtgcccccaaataacttgtcatccctactatcttctgtctagtcatactcctattcaccattctcaactactcatacatgccctgctcttgtttacactgccggtttacactgtttctccaagccatcacagctgatatctcctcgtgctatcctcaaactgccactcttaactcttg

SEQ ID NO: 4124 - DNA, 553 bp, Homo sapiens
  misc_feature (1)...(553): n = A,T,C or G
atgaaatttggtgccgtgactcggatcgggggacctcccttgggagatcaatcccctgtactcctgttctntgctccgtgagaaagatccacctatgacctcaggtcctcagaccgaccagcncaaggaacatctcaccaattttaaatcaggacaccactgaaaatcggactgttcaactcacctggcagccactcccagagcccctggaactctggcccaaggctctctgactgactccttcccagattttctcagcttagcagctgaagactgacgctgccggatcgcctcggaagccccctagaccatcacggacgccgagcttccggtaactctcacagtggaagactcagcccgcctgcacccaggtgaaataaacggccatgttgctcacacaaagcctgtttggtggtctcttcacacggacgcgtgtgaaatttggtgccaaaacccgggtacatcttcctgaatcaggcttctgagaactgttccactttgcagtcctgttggatctatatcttgagaaataaattaaagagcttttccctcc

SEQ ID NO: 4125 - DNA, 544 bp, Homo sapiens
  misc_feature (1)...(544): n = A,T,C or G
ttcggactcagcccaccatgcacccaggtgaaataaacagctttactgctctcacacaaagcctgtttggtggtctcttcacacggacgcgcatgaaatttggtgctgtgactcggattgggggacctcccattgggagantcaatcccctgtcctcctgttctttgctccatgagaaagatccacctacgacctcaggtcctcagaccgaccagcccaagaaacgtctcaccaatttcaaatccgccactcccagagcccctggaactctggcccaaggctctctgactgactccttcccagatcttctcggcttagcggctgaagactgacaccggccgatcgcctcggaagccccctagaccatcacggatgccgagcttcgggtaactctaacagtggaagaggccaggctaacagggactgctgatggggaaataagaattatcaaggatgaatcctatatctgggggcttgagcaaatacgttcaagtcctgacactggtacctgtgaatgtgatcttatctggnaagagagactttt

SEQ ID NO: 4126 - DNA, 488 bp, Homo sapiens
  misc_feature (1)...(488): n = A,T,C or G
aacatgtgtgtacatatagcgganggaattaacagagaaaaaagctgaagaagtaagagggataagacaatggtgactgatcgctggagccaggtcctttaggagagagaagataagaatccagagcactcacaaggnaattggcccccgtcaagaggaaaaatagcataaatctaggagagtgtgtaatanatctgcgccttatcaaccaaattgttttgnctgtccaccctgtggtgccaaacccatataactctcctatcctcaatacctgcctctacaacccatttattctgttctggatctcaaacatgctttctttactattcctttgcacccttaatcccagcctctcttcgctttcacttgggactgaccctggacacccatcaagctcagcaaattacctagggctggtactgcagcaaagcttcacagacaggccccantactttccatcaangcccaaggnttcttcctcatctggg

SEQ ID NO: 4127 - DNA, 301 bp, Homo sapiens
tggaaatcggactgttcaactcacctggcagccactcccaaagccccctggaactctggcccaaggctctctgactgactccttcttggcttagcggctgaagactgatgctgcctgatcgcctcggaagccccgtagaccatcacggatgccgagctttaggtaaccccctttgactgtaattttcctttacctacccaaatcctataaaacggccttacccttatctcccttcgctgactctcttttcggacttagcccgcctgcacccaggtgaaataaacagccatattgctcacac

SEQ ID NO: 4128 - DNA, 304 bp, Homo sapiens
  misc_feature (1)...(304): n = A,T,C or G
ttagaatttacagcttgtcctcgagaagctacagggtatagtctatttgactatatggacataccttcttgctgggcccccaccttgtgccagacaccagccctctaggcgactatcttcnagtcctccagcaggctagacaggaaattcaccagcctnctaatcttctcttgcctactccagattcccagccatatgaagacaccctagctggatgatcagttgttgttaagaatctgatccctcaaactctacaaccgcgatggactgcttagtcatctatagtaccccaactcccgtccac

SEQ ID NO: 4129 - DNA, 358 bp, Homo sapiens
tttacttttctactcactcttatccttgcccctattctccaggcactctctacctctccctagttacctccagcatagtatcaacctcacccactctctcctcactgcctccaatccttctctagtaaaaaattgttggctatgcatttccctttcttcctgctcttatgcagccgtccccgctctacaggctgactgagctacctctcctgtctccctacacctctgaaccttctttaatagcccttgtctttacccacctgaggaacttctttactttctagacagatttggtgagaactccccagagatttcgcattaaaaagcggccacacttctccgcatctacttaccctcg

SEQ ID NO: 4130 - DNA, 448 bp, Homo sapiens
aaaaatagatttaccggaacattccaggatttttacgtacacttatggatgccctgagaaaagacaaaataatctttcctaatgatgaaaagtaagttaatgatgaaaagacatgcattattactgtatctaaaggattctaggggcaactatcatgtgacttactggatggtgacatgagacatcctgaatatcattcttattcttagaatattgttctgcgcttcttaagatgggcactaaagatttgggtaaagtatctatgaatttttagtatttgctattttcctcatgtctaattcaatgacttcaccaattcagtactctctctgaattcataaacgaagttgtatatctatagcctatcaagaccttttaaagggcttggtagtgttagcgtatgcctataatcctagcactttgggaggctgaagtgagaggatagctt

SEQ ID NO: 4131 - DNA, 499 bp, Homo sapiens
cctctcatttcctttccatcatggaaatctatcctcaaggagatcacttctcagtgttccatctgctattctactacccctcagggattgttcaggtcccctccctttcctacacatcaagctcgaagatttgtccctgcccaggactggcaaattgacttaaatacctcttagtctagtcctcagtcttcaggaaaggtagaacggactaatggtcttttaaaaacacacctcaccaagctcagccaccaacttaaaaaagactggacaatacttttaccactttcccttctcagaattcaggcctgtccttggaatgctacaagtcatactcctattcaccgttctcagctactcatacatgccctgctcttgtttacactgccggtttacactgtttccccaagccatcacagctgatatctcctggtgctatccccaaaccgacactcttccactcttgaagtaaataaataatctttaaagaaaggaaaaaaaa

SEQ ID NO: 4132 - DNA, 341 bp, Homo sapiens
ctgtgggcctgcacatatacatgaagatggcctgaagcaactgaagatccaaaaaagaagcgaaaatagtcttacctgatgacattctaccattgtgatttgttcccgccccaccctaactgatacgatatattctgcctggtccttaagaaggtactttgtaatattctcccccgcctttaagaaggtactttgtaatattctccctgcccttgagaatgtactttgtacgcccatcccaaacctataagaactaatgataatcccacctttgctgactctgttttcggactcagcccacctgcacccaggtgaaataaatagcctttttgctcacaaaa

SEQ ID NO: 4133 - DNA, 438 bp, Homo sapiens
cacagtgcttcctttcctctgaatctgccatcagctcaggcagatttctaagcagcaaatcagcctttgccagaacactgcaggacaccagtgcagcgcccagcctgcgaccatgagcctgttggtggtctttttacatggacgggaattaacatttggtgccgtgactcggatcggggaacctcccttgggagatcaatcccctgtcctcctgctctttgttccaagagaaagatccacctacgacctctgctcctcagaccaaccagcccaaggaacatctcaccaattttaaatcgggctctaggggatggtagagtcacaggatggaagaactctgtgtccttgaatcattgcatggaagagaactggaagttgcccaggaacaccagccttggacagttatgtgaacaagaaataaacttcttttacagtgtc

SEQ ID NO: 4134 - DNA, 423 bp, Homo sapiens
acagccacatccttcaaaggtcactgagtcctgagagtaatttgtcaaccaccccagccaccatcctttcctcttcaaaattttgacttcatgaagacagaaaacatctttgagaaagatgatcggtcaatctttcagcaacaggcattactcatctgtcatcaagcgccattcattagccatctctcggggacacgacagaattgtcaggttgctgaggccaggaggacaccaagcgaaggtcaccgtgaacaggaaggcagagatgctgttcctgactgtggctctcagaggaggggccgcgacttgggagagcccacaagatgctcgaaatgcccgaaagtgcacgggacaggctccatttcactgggcacctcccctttccacccttctactctcgcgtggctgcaccgggacaccacc

SEQ ID NO: 4135 - DNA, 355 bp, Homo sapiens
ctactactcctcagggagttgttcaggccccctcccttccctacacatcaagctcggggatttgcccctgcccaggactggcaaattgactttactcacatgcctcgagtcaggaaactaaaatacctcttggtctgggtgggtagaggcctttccacaggtctgaaaaggctactgcggtcatttcttcctttctgtaagacataattccttggtttggccttcccacctctatacagtccaataacggaccggcctttactagttaaatcacccaagcagtttctcaggctcttggtattcagtgaaaccctcatacctcttaccatcctcaatcttcagaaaaggtagaatg

SEQ ID NO: 4136 - DNA, 312 bp, Homo sapiens
  misc_feature (1)...(312): n = A,T,C or G
gcggctatgccgtntggctctgctcgtcctgttgctcctggggnccggcggctggtgccttgcagaacccccacgcgacagctgcgggaggaacttgtcatcaccccgctgccttccggggacgtagccgccacattccagttccgcacgcgctgggattcggagcttcagcggngaaggagtgtggataaatcttggaaggagctcagtaatgtcctctcagggatcttctgcgcctctntcaacttcatcgactccaccaacacagtcactcccactgcctccttcaaacccctgggtctggccaatgac

SEQ ID NO: 4137 - DNA, 318 bp, Homo sapiens
  misc_feature (1)...(318): n = A,T,C or G
cataccacccccaaaaattttcgctgcctcaacacttcaccactattntntnttgtntttcatactaatataagaagataggagtgtcaggccnctgagtccaagctaagccatcaaatcccctgtgacctgcacgtgtacatccagatgacctgaagcaactgaagatccacaaaagaagtgaaagtagccttaactgatgacattccaccattgtgatttgttcctgccccacgctaactgataccatatattcttcccccgnccttgagantgtactttgtacacctatcccanacctataagaactaatgataa

SEQ ID NO: 4138 - DNA, 292 bp, Homo sapiens
  misc_feature (1)...(292): n = A,T,C or G
ataaggagagtaatatgggtttgcctatcccaccccatggtgccaaacccatatactctcctatcctcaatacctccctctactacccattactctgttcnggatctcaaacatgcttnctttactgttcccttgcccccttaatcccagcctctcttcgctttcacttggactgaccctgacatccatcaagctcagcaaattacctaggctgtactgccccaacgctacgtttcttttaattcttcaggcttcccttatctctgctgttcctcttctggtgaggagataa

SEQ ID NO: 4139 - DNA, 256 bp, Homo sapiens
accattgtgatttgttcctgccccaccctaacttgatacgatatattctccctctgccctgaagaaggtactttgtaatagtctccccccaccttaaaaaggtactttgtaatattctccccacccgtgagaatgtactttgtacacctatcccaaacctataagaactaatgataatcccaccaccctttgctgactccttttttggactcagcccacctgcacccaggtgaaataaacagccttgttgctcaca

SEQ ID NO: 4140 - DNA, 206 bp, Homo sapiens
aatcagcctttgccagaacactgcaggacaccagtgcagcgcccagcctgcgaccatgaggctctaggggatggtagagtcacaggatggaagaactctgtgtccttgaatcattgcatggaagagaactggaagttgcccaggaacaccagccttggacagttatgtgaacaagaaataaacttcttttacagtgtcaaaaaaaa

SEQ ID NO: 4141 - DNA, 160 bp, Homo sapiens
  misc_feature (1)...(160): n = A,T,C or G
ttttaaaaacacacctcaccaagctcagcctccaacttaaaaaggactngacagtacttttaccacttgccctnctcagaattagggcctntccttgagaagccacagggtacaacccatttcaattttatatggatgcaccttcttactcagccacaat

SEQ ID NO: 4142 - DNA, 671 bp, Homo sapiens
  misc_feature (1)...(671): n = A,T,C or G
gctctgtgacctgtttactgagcccagggcccagcccctggctgagggaagggctggcaggccgtgttttggtggcctcctccgtccgcctctcagagctttgctgtggccttggggaccgaggcttgtnacaaggtgccgggtggggggggcccaggtccagcgagtacctggaaacccaggcacactgtgtcctggagctgggccatccctcctgctgcttttcccgccctcttcccaccccttttctccctgctttcctccctcccttcctcctctttcctcatcctctccatgtttggaagcctcctgcctggaccacagcctgcacatgcgtcatggctctgggagccagcaaggagtggacagctgtccctgaccaggcagcgactctnagggactccccctccaccctgggctacactgcctgctgctcccctccagggctccccaggtccagtcctgggcatctccaggccaggccctgtgactgtccgcacgacccccgcagacccgggaccagtatccccaggcccagctccatcccagtcagccacacacacctggttgtgggcatctgccacttcctccagtgttggtaactctgcggctttctntactcaggaagcacttggagccgccagctgcaggcgctcctgtcttcgggcacg

SEQ ID NO: 4143 - DNA, 1414 bp, Homo sapiens
gtcgaccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggcaaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagcccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctcccaagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgttttgagacggagttttgctctgtcacccaggctggagtgctatggctcgatcttggctcactgcaacctccacctcccaggttcaagcaattctcttgccccagcctcccgagtagctgggattacaggtgcatgccaccatgggctggctaatttttggaattttaagtaggagatggggtttaacataattggtcaggctga

SEQ ID NO: 4144 - DNA, 418 bp, Homo sapiens
ccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccctgtcactcctctaacacttccctcccctatccccaacatgccctgtaataaaattagagaagactaaaaaaaa

SEQ ID NO: 4145 - DNA, 266 bp, Homo sapiens
  misc_feature (1)...(266): n = A,T,C or G
aaaaaaaaaaaaaaaaaaatgagggcgttactgtgactttacagcaattaaagtgattataagataatactataaacataggtacactagcaaattgaataaccaaatgaaatgggcaaatctctagaaacacaaagcctaccaagactgaatcacaaataaagaaaaaatatcggcaaaccagctgggcatggtggctcccagctgtaatcccagcacttttggagtgcactgcattgcactncagcctnggggccaagagcgag

SEQ ID NO: 4146 - DNA, 2922 bp, Homo sapiens
ccaccccagcctccttggagctatccctttctatccccctccatccagcccctggccaccaccattatatctattctggaattcccacaggaaaagcaggcactttataaatcagcgagggattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgttttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagcccagccccgctgagggaagggctgtcaccaatgagcctgaggaggaggagctggctaccctatctgaggaggagattgctatggctgttactgcttgggagaagggcctagaaagtttgcccccgctgcggccccagcagaatccagtgttgcctgtggctggagaaaggaatgtgctcatcaccagtgccctcccttacgtcaacaatgtcccccaccttgggaacatcattggttgtgtgctcagtgccgatgtctttgccaggtactctcgcctccgccagtggaacaccctctatctgtgtgggacagatgagtatggtacagcaacagagaccaaggctctggaggagggactaaccccccaggagatctgcgacaagtaccacatcatccatgctgacatctaccgctggtttaacatttcgtttgatatttttggtcgcaccaccactccacagcagaccaaaatcacccaggacattttccagcagttgctgaaacgaggttttgtgctgcaagatactgtggagcaactgcgatgtgagcactgtgctcgcttcctggctgaccgcttcgtggagggcgtgtgtcccttctgtggctatgaggaggctcggggtgaccagtgtgacaagtgtggcaagctcatcaatgctgtcgagcttaagaagcctcagtgtaaagtctgccgatcatgccctgtggtgcagtcgagccagcacctgtttctggacctgcctaagctggagaagcgactggaggagtggttggggaggacattgcctggcagtgactggacacccaatgcccagtttatcacccgttcttggcttcgggatggcctcaagccacgctgcataacccgagacctcaaatggggaacccctgtacccttagaaggttttgaagacaaggtattctatgtctggtttgatgccactattggctatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggtcagccacctcattgctacagagtacctgaactatgaggatgggaaattctctaagagccgcggtgtgggagtgtttggggacatggcccaggacacggggatccctgctgacatctggcgcttctatctgctgtacattcggcctgagggccaggacagtgctttctcctggacggacctgctgctgaagaataattctgagctgcttaacaacctgggcaacttcatcaacagagctgggatgtttgtgtctaagttctttgggggctatgtgcctgagatggtgctcacccctgatgatcagcgcctgctggcccatgtcaccctggagctccagcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatataaaaaaaaaaaaaaaa

SEQ ID NO: 4147 - DNA, 770 bp, Homo sapiens
  misc_feature (1)...(770): n = A,T,C or G
gccacgggtagtgccacaatcagggcccagctgcagctccacctcaggncntcaagtatcctgctgacaactttcntgtgtacccttaccagcagggacaccagatttggcacagtcagtcccttgttccaaaaattggaaaatgacagattgaaagttaaggcagcgctttggagggggccaggtgagaaagctaaaggctgtgccctcgctccacaacagccacagcatcacttccctaatttccctaagtagtcctcacccatcactctttccatcttttggccctgccgcttcctcacttacagtttttctttcctgtcttaactagaagagaccttcgacttaaaggtaaccactttccctctgagatgctgtataaaactggaggttaggggatatttatggttgctggtgataactttgttgttctccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatataaaaaaaaaaaaaaaaaaaaaaa

SEQ ID NO: 4148 - DNA, 460 bp, Homo sapiens
ttagcaaatcacttaatctctctaatcctcaatttttttcagttgtgaaatgggataatattagtacctatctcagtgagttattgtgaggattaagtgagatcatataaagtgcttaatacagtgcttgacatataaagtgctcagtaaatgttagatattaccattgggaagaaactgagtgtctcatttgtgtacattttccttttctatccccaacaaaggagacagaatctctagccgacattgttttgtggggagccctatacccattactgcaagatcccgcctacctccctggtgagaactgtgcatatcactccaaccctaggagcttggtgtagggattacagaatgggcagtagaatactgagaactcccttcaaggtacagcttgactgggcaactatagcagaagatggttgagggaactggggaaagcaactggagaaacctcaca

SEQ ID NO: 4149 - DNA, 304 bp, Homo sapiens
gtcgacctgaatcctaaatagatctttttcttgcctcactgttacctccccacccccctttatcttagggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatatacaaaaaaaaaagtcgacg

SEQ ID NO: 4150 - DNA, 442 bp, Homo sapiens
aggacattgcctggcagtgactggacacccaatgcccagtttatcacccgttcttggcttcgggatggcctcaagccacgctgcataacccgagacctcaaatggggaaccctgtacccttagaaggttttgaagacaaggtattctatgtctggtttgatgccactattggctatctgtcatcacagccaactacacagaccagtgggagagatggtggaggacccagagcaagtggacctgtatcagttcatggccaaggacaatcttccttccatagcttaggctttccttctcagccctaggagctagggtaactataccttggcagcaccctatttctacaaggtacctaccattaggatgggaattctaagcccggttggagttttgggaatgcccgacggagtcctctgacttgcgttatctctgatttgctggc

SEQ ID NO: 4151 - DNA, 297 bp, Homo sapiens
ggttttgtgctgcaagatactgtggagcaactgcgatgtgagcactgtgctcgcttcctggctgaccgcttcgtggagggggtgtgtcccttctgtggctatgaggaggctcggggtgaccagtgtgacaagtgtggcgaaactcttggatttaaagaaacagttggctgtagctgaggggaaaccccctgaagcccctaaaggcaagaagaaaaagtaaaagcccttggctcatagaaagtccctttaatagatagggccagtaataaataaatgtccaatctctatatccaaaaa

SEQ ID NO: 4152 - DNA, 683 bp, Homo sapiens
gcactatcaccagctacttgagaaggttcggatccgggatgccttgcgcagtatcctcaccatatctcgacatggcaaccaatatattcaggtgaatgagccctggaagcggattaaaggcagtgaggctgacaggcaacgggcaggaacagtgactggcttggcagtgaatatagctgccttgctctctgtcatgcttcagccttacatgcccacggttagtgccacaatccaggcccagctgcagctcccacctccagcctgcagtatcctgctgacaaacttcctgtgtaccttaccagcaggacaccagattggcacagtaggtggaagagccagcctctcttaaaattgatactcttgccatgcagcttttggagtcggcaccaagagagaagacctaacatctctccagtgttactttggtcatgggactcctaagtttctgatataaagtccttggtagtcgttcacaagtccggaattatctgtacatcttcattgttcttcatgccagaaaccagaacctggcacacaaaactaactggtaaacagatatttgaagaaacactgtgatcacctagtctccataatgctagcagatagtgggcagggaaaatacaggaaagccatttcctctttgacacaaaatgaaaaagtaagtacattgctaaacttctgga

SEQ ID NO: 4153 - DNA, 707 bp, Homo sapiens
  misc_feature (1)...(707): n = A,T,C or G
gtcccttgtatagcntgtgccttacctgngtcaganttaccnctctggagtcgatcggatnctgcgctttcntcccatnctcgactggcaccatntttcngtgatgagccctggagcgattaaggcagtgaggctgacggcaacgggcagggacagtgactggcttggcagtgaatatagctgcttgctctctgtcatgcttcagccttacatgcccacggttagtgccacaatccggcccgctgcagctcccacctccagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcactttaatagatagggacagtaataaataaatgtacaatctctatataa

SEQ ID NO: 4154 - DNA, 409 bp, Homo sapiens
ctgcataacccgagacctcaaatggggaacccctgtacccttagaaggttttgaagacaaggtattctatgtctggtttgatgccactattggcttatctgtccatcacagccaactacacagaccagtgggagagatggtggaagaacccagagcaagtggacctgtatcagttcatggccaaagacaatgttcctttccatagcttagtctttccttgctcagccctaggagctgaggataactataccttggcgaaactcttggatctaaagaaacagttggctgtagctgagggaaaccccctgaagcccctaaaggcaagaagaaaaagtaaaagaccttggctcatagaaagtcactttaatagatagggacagtaataaataaatgtacaatctctatatac

SEQ ID NO: 4155 - DNA, 579 bp, Homo sapiens
  misc_feature (1)...(579): n = A,T,C or G
gttccgatttnaatccgcttccttttaggnaatttgccttcgagccaagattcggcacgagggcttacagcaacgggcaggaacagtgactggcttggcagtgaatatagctgccttgctctctgtcatgcttcagcctgcagtatcctgctgacaaacttcctgtgtaccttaccagcaggacaccagattggcacagtcagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgttggatgaagtgacaaaacaaggaaacattgtccgagaactgaaagcacaaaaggcagacaagaacgaggttgctgcggaggtggcgaaactcttggatctaaagaaacagttggctgtagctgaggggaaaccccctgaagcccctaaaggcaagaagaaaaagtaaaagaccttggctcatagaaagtcacttttatagatagggacagtaataaataaatgtacaatctctata

SEQ ID NO: 4156 - DNA, 404 bp, Homo sapiens
  misc_feature (1)...(404): n = A,T,C or G
cctgactcacattgaccacagcttgagtcgtcagaactgtcctttcctggctgggaggagctgagtgccctgcatagctggttccagacactgagtacccaggaaccatgtcagcgagctgcagagactgtactgaaacagcaaggtgtcctggctctccggccttacctccaaaagcagccccagcccagccccgctgagggaagggctgntcaccaatgagcctgaggaggaggagctggctaccctatctgaggaggagattgctatggctgttactgcttgggagaagggcctagaaaagtttgcccccgctgcggccccagcagaatccnagtgtttgcctgtgggtgggagaaaggaatgttgctcatcaccagttgccctcccttacgntaacaatg

SEQ ID NO: 4157 - DNA, 402 bp, Homo sapiens
  misc_feature (1)...(402): n = A,T,C or G
cccacctcccagccttgnagtatcctgctgacaaaacttcctgtgtacctttacccagcgggaccacccagattggccacagtnagtcccttgttccaaaaattggaaaatgaccagattgaaagtttaaggcagcgctttggagggggccaggcaaaaacgtccccgaagccagcagttgtagagactgttacaacagccaagccacagcagatacaagcgctgatggatgaagtgacaaaacaaggaaactcttggatctaaagaaaccagtttgnctgtagctgagggaaaccccctgaagcccctaaaggcaagaagaaaaagtaaaagaccttggctcatagaaagtcactttaatagatagggacagtaataaataaatgtacaatctctatatac

SEQ ID NO: 4158 - DNA, 227 bp, Homo sapiens
  misc_feature (1)...(227): n = A,T,C or G
ctcgtgcgctnggctgcgacatctgtcaccccattgatcgccagggttgattcggccgatgccagcctggnggtctcattcagccagccaatcatgtattgccagcctgcagtatcctgctgacaaacttcctgtgtaccttaccagcaggacaccagattngcacagtcagtcccttgttccaaaaattggaaaatgaccagattgaaagtttaaggcagcgcttt

SEQ ID NO: 4159 - DNA, 2902 bp, Homo sapiens
gaattccggcaaacatgaggcagctgccagccggcctgggcagtcttgtctgcctcggctgtgaagtggggaggctggcaacagttttcttcagcgcccaggacgcagccggctaaggaagtgacaaaggcgtcggacggcagcctcctgggggacctcgggcacacaccacttagcaagaaggagggtatcaagtggcagaggccgaggctcagccgccaggctttgatgagatgctgcctggtcaagtggatcctgtccagcacagccccacagggctcagatagcagcgacagtgagctggagctgtccacggtgcgccaccagccagaggggctggaccagctgcaggcccagaccaagttcaccaagaaggagctgcagtctctctacaggggctttaagaatgagtgtcccacgggcctggtggacgaagacaccttcaaactcatttacgcgcagttcttccctcagggagatgccaccacctatgcacacttcctcttcaacgcctttgatgcggacgggaacggggccatccactttgaggactttgtggttggcctctccatcctgctgcggggcacagtccacgagaagctcaagtgggcctttaatctctacgacattaacaaggatggctacgtcaccaaagaggagatgctggccatcatgaagtccatctatgacatgatgggccgccacacctaccccatcctgcaggaggacgcgccggcggagcacgtggagaggttcttcgagaaaatggaccggaaccaggatggggtagtgaccattgaagagttcctggaggcctgtcagaaggatgagaacatcatgagctccatgcagctgtttgagaatgtcatctaggacacgtccaaaggagtgcatggccacagccacctccacccccaagaaacctccatcctgccaggagcagcctccaagaaacttttaaaaaatagatttgcaaaaagtgaacagattgctacacacacacacacacacacacacacacacacacacagccattcatctgggctggcagaggggacagagttcagggaggggctgagtctggctaggggccgagtccagaggccccagccagcccttcccaggccagcgaggcgaggctgcctctgggtgagtggctgacagagcaggtctgcaggccaccagctgctggatgtcaccaagaaggggctcgagtgccctgcaggagggtccaatcctccggtcccacctcgtcccgttcatccattctgctttcttgccacacagtggccggcccaggctcccctggtctcctccccgtagccactctctgcccactacctatgcttctagaaagcccctcacctcaggaccccagaggaccagctggggggcaggggggagagggggtaatggaggccaagcctgcagctttctggaaattcttccctgggggtcccagtatcccctgctactccactgacctggaagagctgggtaccaggccacccactgtggggcaagcctgagtggtgaggggccactggcatcattctccctccatggcaggaaggcgggggatttcaagtttagggattgggtcgtggtggagaatctgagggcactctgccagctccacaggtggatgagcctctccttgccccagtcctggttcagtgggaatgcagtgggtggggctgtacacaccctccagcacagactgttccctccaaggtcctcttaggtcccggggaggaacgtggttcagagactggcagccagggagcccggggcagagctcagaggagtctgggaaggggcgtgtccctcctcttcctgtagtgcccctcccatggcccagcagcttggctgagccccctctcctgaagcagtgtcgccgtccctctgccttgcacaaaaagcacaagcattccttagcagctcaggcgcaccttaggtgggagcccagcacactgcttctcggaggccaggccctcctgctggctgaggcttgggcccagtagccccaatatggtggccctggggaagaggccttgggggtctgctctgtgcctgggatcagtggggccccaaagcccagcccggctgaccaacattcaaaagcacaaaccctggggactctgcttggctgtcccctccatctggggatggagaatgcagcccaaagctggagccaatggtgagggctgagagggctgtggctgggtggtcagcagaaacccccaaggaggagagagatgctgctcccgcctgattggggcctcacccagaaggaacccggtcccagccgcatggcccctccaggaacattcccacataatacattccatcacagccagcccagctccactcagggctggcccggggagtccccgtgtgccccaagaggctagccccagggtgagcagggccctcagaggaaaggcagtatggcggaggccatgggggcccctcggcattcacacacagcctggcctcccctgcggagctgcatggacgcctggctccaggctccaggctgactgggggcctctgcctccaggagggcatcagctttccctggctcagggatcttctccctcccctcacccgctgcccagccctcccagctggtgtcactctgcctctaagccaaggcctcaggagagcatcaccaccacacccctgccggccttgccttggggccagactggctgcacagcccaaccaggaggggtctgcctcccacgctgggacacagaccggccgcatgtctgcatggcagaagcgtctcccttggccacggcctgggagggtggttcctgttctcagcatccactaatattcagtcctgtatattttaataaaataaacttgacaaaggaaaaaaaaaccgaaaaaa

SEQ ID NO: 4160 - DNA, 476 bp, Homo sapiens
  misc_feature (1)...(476): n = A,T,C or G
gctcccgcctgattggggcctcacccagaaggaacccggtcccaggccgcatcccttccaggaacattcccacataatacattccccaggctccaggctgactgggggcctctgcctccaggagggcatcagctttccctggctcagggatcttctccctcccctcacccgctgcccagccctcccagctggtgtcactctgcctctaaggccaaggccttcaggagagcatcaccaccacacccctgccggccttggctttggggcagaactggctgtcacagcccaaccagggaggggtctgcctcccacgctgggacaaagaccgggccgcatgttttgcatgggcagaagngttttccttngggccaagggttggggangggtngtttcntttttttcaagnattccattaantatttcaattctcgttataattttaantaaanttaaatttgaanaaaaggnaaaaaaaa

SEQ ID NO: 4161 - DNA, 494 bp, Homo sapiens
agcccagctccactcagggctggcccggggagtccccgtgtgccccaagaggctagccccagggtgagcagggccctcaaaggaaaggcagtatggcggaggccatgggggccccttggcattcacacacagcctggcctcccctgcggagctgcatggacgcctggctccaggctccaggctgactgggggcctttgcctccaggagggcatcagctttccctggctcagggatctttctccctcccctcaaccccgctgcccagccctcccagctggtgtcacttggccttggggccagactggctgcacagcccaaccaggaggggtttgcctcccacgctgggacacagaccggccgcatgtttgcatggcaaaagcgtctcccttggccccggcctgggagggtggttcctgttttcagcatcccctaatattcagtcctgtatattttaataaaattatcttgaccaacgaaaaaaaaaaaaaaaaaa

SEQ ID NO: 4162 - DNA, 4582 bp, Homo sapiens
ccgagaagggcttcaggacgcgggaggcgcacttgcttcaagtcgcgggcgtgggaacggggttgcaaaacggggcctttttatccgggcttgcttccggcgtcatggctcaaagggccttcccgaatccttatgctgattataacaaatccctggccgaaggctactttgatgctgccgggaggctgactcctgagttctcacaacgcttgaccaataagattcgggagcttcttcagcaaatggagagaggcctgaaatcagcagaccctcgggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttcctttgtggggatgcaggccccctggcagtggccgctgtgctatatcacaagatgaacaatgagaagcaggcagaagattgcatcacacggctaattcacctaaataagattgatcctcatgctccaaatgaaatgctctatgggcgaataggctacatctatgctcttctttttgtcaataagaactttggagtggaaaagattcctcaaagccatattcagcagatttgtgaaacaattttaacctctggagaaaacctagctaggaagagaaacttcacggcaaagtctccactgatgtatgaatggtaccaggaatattatgtaggggctgctcatggcctggctggaatttattactacctgatgcagcccagccttcaagtgagccaagggaagttacatagtttggtcaagcccagtgtagactacgtctgccagctgaaattcccttctggcaattaccctccatgtataggtgataatcgagatctgcttgtccattggtgccatggcgcccctggggtaatctacatgctcatccaggcctataaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttgctgaatggtgcttagagtatggagaacatggatgcagaacaccagacacccctttctctctctttgaaggaatggctggaacaatatatttcctggctgacctgctagtccccacaaaagccaggttccctgcatttgaactctgaaaggatagcatgccacctgcaactcactgcatgaccctttctgtatattcaaacccaagctaagtgcttccgttgctttccaaggaaacaaagagtcaaactgtggacttgattttgttagcttttttcagaatttatctttcattcagttcccttccattatcatttacttttacttagaagtatccaaggaagtcttttaactttaatttccatttcttcctaaagggagagtgagtgatatgtacagtgttttgagattgtatacatatattccagaacttggaggaaatcttatttaagtttatgaatataaccatctgttactgttctaaaaatgtttaaaagaaactcaatacagataaagataaatatgtgactattattgggtattacacttcacttctctttaatatttttcctccaactggagggcagacaattttctgacttgcttttctctaggtggttcattttgaaaggggacagaaatataactaaatgcttccaggagaaaaattccaagagttacaatctggacttggtacctaaatatcattttttaaattcttgatgcctatttggactagaggtaaacatactttcagattggcctgtttttgtcggtaaggcatacagccttcagaagccaacatttttaatcaaaaacttataaaacatgatgatcattgtgaaaattctgagttgaaggttagtttaagataagctaacaataacagtctgtgttttctctaaaataatctgagttttttggaactctttatttaaatatgtgtgtttttcagtattcaaataagatcaggaagccaattttctatgtatgaatatgctttaacctaggatttcagtccactctgactgactttctaaactttaacttgggtttttacagtgactatgcattagtgctgactctttggtataagccataaaatattttccttcctatcaatttatctgaactttggtcttttcactaaattgtacagtattctacttctgtttaaaaaggggagatgagaaagggaatactatctaaccaataacttgaacaaaaacactaaactaagcatttaatagaaatgctttttattgaggaggtattatccagagttcatgcttagaacaaatgcatctttgcgtatcctagacttaacaattcatcagtttctgagaccacagaatcaggttttccgtagtagataaagactctctggtgcttcaaattctgttcaagtgttttgactcatcagcttctactctttctattactgcctttgcctggcttgttttgtctctttgcaactgattttgcaaaaaaaaattgtagctttaaaataacagggtctaagtattttaaatgtgcctatttcacagctctcttggtcacaaaaacatgctatttttattggaacttcaaaccaaatccccactgagtgtgtactggttcctgcaggtagcagtctcctattatctcctgtttagcaccaaaagagctaatattattggaaactgaccttttaaaggccactggcagtaggatttaaaaagcagcccactgctcagtttccaggatcagcttcctccttctgtcacttgtgtaagttggcactaccttgtgcctctcagattgctgaagtgctgctggtaagcatgtgcatgctctgcctttcttgtgaaagttttcaatcagcgatatcagcacttacagtaagaagtaaaagtagtgcacagcaaagctaatttgcctttgcctggggtgttcagcttgaaagaataaagctcatttggtttagttaaatgtcttactctactgtgcctatgcttttagctgcgttactaagcaagggaaaaataacagtttctctgagccagagaagacttgatcacagttctccaagcatcgtgatagcaatgcttaaccccaggaagatttcaaggcagggagaagaacatttcaaataagattcttgttaacccatttatgcctagtgttccattattggaatgctaagcttgtgggagtcatttacatcctactgctcaaagtcattgccaaggtctgatttttcacacaaaaaattgcaacccccagcataaatgggttagctactgtcatcagttagcaaattcatccacacaaacacaattagagtttggtttttttttaagcttttcaaaacttactaaactggcacaattttatatgtatgctatttgttgtatttatgcttaagagcaaaaaagttttgatgggattttaaattcaggcaaagcctacaacgctgagacaatcccctaacaacatggtagtaactaaagaaacttttatactaggcttcttagttttaaaaggaagtggcatcattgtttcagttctagtttgtatttttctctcagatatttttcttctttaaaaatctttcccagaagttggttcctagaaaactcaataccatcatctcttatctctatacagggactaggtaataaaaccttcaaaggttgtcaaaggtcatcaagcagtgttcatttatcctgtcacatgtttctgtttctatagtaatttagaaattgcaaatagttaacttttcatcatgtaaaaagttaacattatcctatttccatagataccatggacggcggtgtggcctgagttgtcagtctttaatcctgagtcatgtggctctcttttcatctttgatgtcagttccaattatttggcatcaaaaaccttcatggtaggtagagttttaggtaaaagtggatctagggttactttctttattaacatttcctaaataactgaattgagagacatactctgctactatgtcctcaggttaatttttgtctgatcttacgatgccctgccttttactagctactttagaaatagaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactataaaaaaaaaaaaaaaaaaaaaaaaaaaaaaaaaaaaaaaaaaa

SEQ ID NO: 4163 - DNA, 758 bp, Homo sapiens
  misc_feature (1)...(758): n = A,T,C or G
cgaattgagatagacattgtatcagaagaaagcagttttgaacaaagagagcgaattactagccagttaacaagtgtcagctgttttataagcatggcataacacttcctaaattgtgcactgcattgttcagttaaaggaattggcgttctgtgactttttgacagttaaataatttgagaacttctgcattttgggcctgtgctcttggaaatccagaatgtacattaacttatttatgcctagtgttccattaatggaacgctaagcatctgggagttctttatatcctactgctcaaggtcatcgccaaggtctgatttttcaccctcaaaaaattgcaaccttagacataaatacaggagtcctatgagtcattaatatactaaacaaactttcttgtttaactctgctttttctaaacttacatgcttagtgatcattctttgcagggcgtgttttgagaaacatagtaatagcaagtagttaagtttctatctacctggtgttcacagtgggagtagtatagaggaagacccaagtttagcctttggaaaacctgagtttgtgggttttaatgcctttagtgaacactatattggaaaagttaatttaagtccccatgattgttncttttgtaaaatatagtacattncccattctaatnacagtgatnagatgtttatagtnccaaaagctatataaagncttcatataggttgaatggcccctccttttatgctaatgtaggnccacat

SEQ ID NO: 4164 - DNA, 500 bp, Homo sapiens
agggcatcagcagaagctgagatagagatattggtcatggttgactgaggagccaattaaaacctgtttatgcctagtgttccattattggaacactaagcatgtgggagttatttatatcctactgctcaaggtcatcgccaaggtgtgattggaaaaattcaaaaaattgcaacctcaggcataaatgggttaaggacatcccaagcccaagtggtacgtgcctcactcagaactgacggcccgagttctatctaggtgtgtcttccagaacctgtttacggctaactggataactgagagacttgtcatttctaaagacatttaagttgctccagggatttctgaaaaaagacacaggcttcttcctagagccagccctatataacatgcccacaagggcaacagttatcacagttcatacacacctttcatgtcctgtctcactcactcctcacagccatcctaggagatacatattgttttaatcctgcatttac

SEQ ID NO: 4165 - DNA, 441 bp, Homo sapiens
  misc_feature (1)...(441): n = A,T,C or G
gatttgtgaacanttttaacctctggagaaaacctagctaggaagagaaacttcacggcaaagtctccactgatgtatgantggtaccaggaatattatgtaggggctgctcatggcctggctggaatttattactacctgatgcaggtattcagagaggaaaagtatctctgtgatgcctatcagtgtgctgatgtgatctggcaatatgggttgctgaagaagggatatgggctgtgccacggttctgcagggaatgcctatgccttcctgacactctacaacctcacacaggacatgaagtacctgtatagggcctgtaagtttnctgaatggtgcttagagtatggagaacatggatgcagaacaccagacacccctttctctctctttgaagggaatngctggaacaatatatttcctggctgacctgctagtccc

SEQ ID NO: 4166 - DNA, 398 bp, Homo sapiens
  misc_feature (1)...(398): n = A,T,C or G
tcttgatctcctgacctcatgatccacccgcctcagccacccaaagtgctgggattacaggcgttgccaccgcgcctggctgaaaaaatacaattcttgttccattatattttaactcttgtctaaatcagttttgtggaaatcatctaacttgaaccctagtgttccattattggaacgctgagcatgtgggagttattcatatcctactgctcaaggtcatcgccaagatctaatttttccactcatgcaaaaattaaaaaaattgcagcctccggcattaaatggggttaataggcagaggaaatacctcagtatttaggaggactacagaagggtgactttaagttgttttttaaaattgtgggagttatttcagggaaggtggtggngttgga

SEQ ID NO: 4167 - DNA, 788 bp, Homo sapiens
gcgaggcttttccaaaacatgtcaagccagagaaaggttcctgggataaagagagaggctcatgaggagacaacacttcataaatcttcagggacgcatggagtcttcaggggtttgagagagtctcaggtgacagcgggattttcctagcgtagtaaaggattcacttcaataaaaggaaaactttctaataatcagaggcttttgtgaaatcattccttgctagggctgtgcgtgaggacctcttcgggagtttttcccctgcaaaatacaaataactttggctctgcctttacaagtttagctctgtattttgcagtgggacctgaatacacatattgtgagaacgctccccagcagattttggtgcctatcgtgattaagaacaattttttattaacccatgtatgcctagtgttccattattggaacgctaagcatgtgggagttatttacatcctactgctcaaggtcatcgccaaggtctgattgcaaaaattcaaaaacctgcaacctcagacatgaatggattaattgccatttgttttgttttctaatggaaaataagaactgatttcctcgctctgttaggtagcaatctgatgtaccctttctctccacccaccacaccatatataagcaaaactggtctctgtttttccaccaacacttatttctcatttgtggattgagctaaaaacacacacaattaaaaaagaaacataaagccaaccctttttctctgcaggtagtaattaaggtgatttgttagttagttgggtttttcc

SEQ ID NO: 4168 - DNA, 415 bp, Homo sapiens
ccatggacggcggtgtggcctgagttgtcagtctttaatcctgagtcatgtggctctcttttcatctttgatgtcagttccaattatttggcatcaaaaaccttcatgtgtgccggaccagtcaaagaatcccacgtcaaaattgagagaacgaacaagccttcatcgcatggcacatttgtataaaaagaaagggagagatgttgcaggaagtcagggaccccaaacagagggaccggctgaagccatggcagaagaacataaattgtgaagatttcatggacatttattagttccccaaattagtacttttataatttcttatgcctgtctttactgcaatctctgaacataaattgtgaagatttaatggacacatcacttccttaatcaatactcttgtgatttcctaaaa

SEQ ID NO: 4169 - DNA, 388 bp, Homo sapiens
gcggccgcgactactactactagcctactactactaaattcgcggccgctcgacaaaatgtgaagagtgactatttacatgtatactcctttggctgctagaactcatctgtagtcctttattatttacactgaattccaatttcatttctgcttccgctaagtaagagcacctcattcctgtgttttctctactattgagctgtagacgaactgtttctctaattataaagcaaactgtttgggatattcagggaaactaccccaatgttatgttgtcatttaatgggaaaggctgggatcatatgtatttctatgttctgtaaagtatttgacttactagttctcaataaaattttattaggactataaaaaaaaaaaaagtcgac

SEQ ID NO: 4170 - DNA, 327 bp, Homo sapiens
gcgtcatggctcaaagggccttcccgaatccttatctgattataacaaatccctgccgaaggctactttgatgctgccgggagggtgagtttaggatatgtctgcctgcatccctgcctctccccacggtgttcggaaaggtgctcatttttgcctgagagagttgagcatccccctttaaaaaaaatacatgattcgacgataaatacgtaaattatttaaaaatacatgttaatatatacaaattgagctctaacataatgttaaatgtgtcattgttaacattattaattgaaataaactcaattattgatagtataaatttta

SEQ ID NO: 4171 - DNA, 236 bp, Homo sapiens
  misc_feature (1)...(236): n = A,T,C or G
aggttgtcaaaggtcatcaagcagtgttcatttancctgtcacatgtttctgtttctatagtaatttagaaattgcaaatagttaacttttcatcatgtaaaaagttaacattatcctatttccatagataccatggacggcggtgtggcctgagttgtcagtctttaaacctagatccacttttacctaaaactctacctaccatgaaggtttttgatgccaaataattggaacg

SEQ ID NO: 4172 - DNA, 231 bp, Homo sapiens
cgtcgacgacacatttacatgttttttttttagtatctatatcctgaataactggctatacttaaatcatttatgcctagtgttccatcactggaacgttaagcatgtgggagttatttatatcctactgctcaaggtcagcaccaaggtctgatgatttttcacaaaaaaattttgcaacctctggcataaatgacctaagaatgattagagtgtagtcagttgtcgagc

SEQ ID NO: 4173 - DNA, 603 bp, Homo sapiens
  misc_feature (1)...(603): n = A,T,C or G
gaacctgggaggtggaggttgtagtgagcctaagggaggagaccacccctcatattgtnttatgcccaatttntgcctccaaagaaagaaaaagtaaaaactaaaaggcagaaatgaaatccacaagcagacagcccggggccacaccctggacctggtagttaaagatggacccctgacctaattggttatgttatctatagattccagacattgtatagaaaagcactgtgaaaatccctatcctgttttgttacgacctaattaccggtgcatgcagcccccagtcacgtaccccctgcttgctcaatcgatcacgaccctctcacgcacacccccttagagttgtgagcccttaaaagggacagaaattgctcactcggggagctcggcttttgagacaggagtcttgccgatgcccccagccgaataaaccccttccttctttaactcggagtctgaggagttttgtctgtggctcgtcgtactacaagccaagatggtgccattgcactccagcctgggcaacaagagcaaaactctatctcaaaaaaaaaaaaaaaaagtcgaccggtttttaatttagtagtagtaggcggcagc

SEQ ID NO: 4174 - DNA, 578 bp, Homo sapiens
  misc_feature (1)...(578): n = A,T,C or G
agcccngacctaaccagttatgttatctatagattccagacattgtatagaaaagcactgtgaaaatcccgtcctgttctgttctgttctaattaccggtgcatgcaacccccagtcacgtaccccctgcttgcccaattgatcacgaccctctcacgcagactcccttagttgtaagcccttaaaaaggtcaggaattgctcactcggggagctcagtttttggagacgtgagtcttggccaaagctcccagccaaataaagcccttccttctttaactcggtgtctgaggggatttgtctgcggcttgtcctgctacagggttacagggcgtgagctaccacatccaggcacatgtgtattaactttctttaaaacattttaaggcactgcagtaaatttgggtctcaaagttggacacaaggaggtccctgggccgggtgtaggtaaggtagctcttgcccattaatccaaacagtttcggaggctgaaggggggaggactgcttgaggctgcagtgagccatgatcgggccactgcaccccagcctgggtgacagagcaagtcaccattgtcaa

SEQ ID NO: 4175 - DNA, 413 bp, Homo sapiens
aatggtgcaagctcggctcactgcaacctctgcctcctgggttcaagtgattctcctgcctcagcctcccaagtagctgggattacaggtacctgccacaatgcccagctaattttttgtatttttagtagagacggggtttcaccatgttggccaggctggtctcgaactcctgacctcaggtgatatacccgccttggcctctccaagtgctgggattacaggcgtgagccactgcgcccgtcctaaaatcattttccacagtctttcaaattcccttatcttttgggaataggggattaaaaatagtataataggatatatttaataatttgattgctataaacaaagaaaactgaattggggatttaaaactaaatatgtcttgaatctattttaaactgcttttcgtc

SEQ ID NO: 4176 - DNA, 379 bp, Homo sapiens
  misc_feature (1)...(379): n = A,T,C or G
accagggaggcagaggctgcagtgagtcgaggttgcgccactgcactccagcctgggcaacagagcaagaatttgtctcaaaaaaataaaatatcaggccaggtgtggtggctcatgcctgtaatcccaggactttgggaggccaaggcgtgagcacctgcgcccgtcctaaaatcattttccacagtctttcaaattcccttatcttttgggaataggggattaaaaatagtataataggatatatttaataatttgattgctataaacaaaganaactgaattnggganttaaaactaaatatgtgatgaatctattttaaactgcttttncttttaaataaaagtctnggcccacttacaataggngcacctattt

SEQ ID NO: 4177 - DNA, 435 bp, Homo sapiens
  misc_feature (1)...(435): n = A,T,C or G
gnggagagcattaggattttaaggggagggagacccacccctcatattgtcttatgcccaatttctgcctccaaaagaagaagtaaaaactaaaaggcagaaatgaaatccacaaagcagaccagctcggcaccacactctgggcctggtaaagatcgacccctgacctaatcggttatgttatctgtagattagagacattgtatagaaaagcactgtgaaaatccctgtcctgttctgttccgttctaattaccggtgcatgcagccccccagtcatgtacccccgcttgctcagtcaatcacgaccctctcacacggacctccttagagttgtaagcccttaaaagggacaggaattactcacttggggagcttggttgttggagacgtgagtcttgccgaagatcccggccgaataaagcccttctttctt

SEQ ID NO: 4178 - DNA, 340 bp, Homo sapiens
  misc_feature (1)...(340): n = A,T,C or G
atgccttgtaaccccaagcaacttttgacgaggatcaaagagatcgagaccatccctggcccaaacatgggtgaaacccccgtctttggggancttgggttgttggagacgtgagtcttgccgaagatcccggccgaataaagcccttctttcttaaactcgctggctgaggggttttgtctgcggcttgtcctgctacaatttaagtactgtttaactggattggaactgagcataacttcctgtaaatcctcctattctctttccaaatacaggatgtaaaaagccatttaatctcattcttgtgaaatctgcagctgccaagaaacaaccaatgttg

SEQ ID NO: 4179 - DNA, 298 bp, Homo sapiens
  misc_feature (1)...(298): n = A,T,C or G
ttgttccattttgtagattggtatcatcatctccctgagaaacctttactacaattaagggaggagaccacccctcatattgtnttatgcccaatttctgcctccaaaggaagaagaagtaaaaactaaaaggcagaaatgaaatccacaggcagacagcccggcgtgctgcgccctgggcctggtaaagatcaacccctgaccgattccagacattgtatggaaaagcattgtgaaaatccctgtcctgttctgttctgattacctgtgcttgcagccccctgttacgtaccccctg

SEQ ID NO: 4180 - DNA, 1068 bp, Homo sapiens
gaaaagagtgggacagggacaagcatatctaagaggctgaacatgaatccacagatcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccagggaggggctccgcagcctgagtcaggaaggggtcgctgtgggagatcatgggactatggaagattttaaaatattgttggggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatgctaggctgggcatggtgactcacgcctgtaatcccccagcaatttgggaggcaaaggtgggagaatcgcgtgagcccaggagttccagaccaggctgggtcacatgacaaagccccatctctacaaaaaaaaaatcgacg

SEQ ID NO: 4181 - DNA, 414 bp, Homo sapiens
caggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaagattttgtatcttgttggaaaaactttgagaccagcctgggccacacgacaaagccccatttctacaaaaaaaaaatacaaaaaaaaagccagatgtggtggcatgcacctgtagtttaagctacttgggaggatgaagtgggaggactgcttgagccggggaggtggaggctggagtaaactgagatcgcgccacagaactccagtttgagcaacagatcgagaccctgcctgaaaataaatcaataaatacactcaacct

SEQ ID NO: 4182 - DNA, 424 bp, Homo sapiens
cctcagaggcagagattgcagtgagctcagatggccgccactgcactccagtctgggtgacagagtaagactccgtcgcgaaaaacaaaaaacaaacaataacaactacaaaaagagttaagtctctacctcaaagtgaacatgggttgtatgttacatgcatgtttgttcaataagcatgagtcaggatgaccttcataattattcatagctcctcctgtaacctgttgaatatgtatgtttagccaacctattcagcatcaagttcctacccctgctcctcctttgaagtgcctgtctctggtctttgccagagattgtacttcctggcctgtgggatggccaccttgcaggcctttaaccctttataagaaataaagtctcctctccaaattaaaaaaaaaaaaaaaaaaaaaaaaaaaaa

SEQ ID NO: 4183 - DNA, 553 bp, Homo sapiens
gagacagagtgttgctcctcttgtccaggctggaatgcaatggcacaatctggactcactgcaacctccgcctcccgagtttaagcgattcttctgcttcagcctcccgagtaaaaggcatgcatcaccacacctggttaattttgtagttttagtagagatggggtctcaccatgttggccagactggtctcgaactcctgacctcaggtgatccgcctgtctcagcctctccaagtgctgggattacaggcatcagccactatgcccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgcaaaaaaaaaaaaaaaaaaaaaaaa

SEQ ID NO: 4184 - DNA, 302 bp, Homo sapiens
gcttgctgttagctagcggaggcagctgctggtggcccaggtgctcgacaccaggcatcccctctcctcccacgaagggtgtgccataatccccttcaacaggaaatgcttcccagaagcctttcagcagcctcccctcctgtcctatcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaaaaaaaaaaaaaaaa

SEQ ID NO: 4185 - DNA, 500 bp, Homo sapiens
caggtcacctggtacacatcttggagcccttgcccagactgtgcaggggaggtggccgagttcctggccaggcacagcaacgtgaatctcaccatcttcaccgcccgcctctactacttccagtatccatgttaccaggagggcgccgcagcctgagtcaggaaggggtcgctgtggagatcatggactatgaagattttaaatattgctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgcttcctaaatgtctgtctctggtgttaaccagaggctgctcttcccaggctgctggatggctaccttgcaggctgtcacccttaacaagaaataaagtgtccctttgcaaatgcaaaaaaaaaaaaaaaaaaaaaaaaaaaaaaaa

SEQ ID NO: 4186 - DNA, 468 bp, Homo sapiens
aactggctgtttcacttcttttgtgtttttttggctgctccagacttcttggctgctgcaggccatctggatgtatatgtgcagttcacaggggtcacaatggcttagctccggctcagaggcctgacactgacctcagatgatccacctgcctcggcctcccaaaatgctgggattacaggcgtgagccactgtgcccgcctgggatcatatgttacacgcatgtttgttcaataagcatggagtgcagccacccacatgaatattcatagctcctcctgtagcctgttcaatatgtatgtttagccaaccccttcagcataaagctcctgccccaacccctcctgcttctaaatgtctgtctctggtgtttcccagaggctgctcttcccaggctgcgggatggctaccttgctgcctgtcacccttaacaagaaataaagtgtcatttgcaaatgcaaaaaaaaa

SEQ ID NO: 4187 - DNA, 263 bp, Homo sapiens
ccaagaattcggcacgaggcgctgtggagatcatggaatatgaagattttaaatattgttgggaaaactttgtgtacaatgataatgagccattcaagccttggaagggattaaaaaccaactttcgactcctgctcctaaatgtctgtctctggtgttaaccagaggctgctcttcccaagctgctggatggctaccttgcaggctgtcacccttaacaagaaataaagtgtcctttgcaaatgcaaaaaaaaaaaaaaaaa

SEQ ID NO: 4188 - DNA, 534 bp, Homo sapiens
ttttttttttttcaaagaaatcaatgaatttattcttatcaaatcagttaaatactcattaaacacttgtgtgcccaactggggttgagaatgcaaaaacagaaatgagtgcagaattcctgtttacaaattagctgggtcagacatccttacagaaagaaacaaccaggaaatgagtatacattcacttcaagaatcttttctttttttttgtagagatgcagtcttgctatgttgcccaggctggtctccaactcctagcctcaagtgattctcccaccccggcctccgaaagtgctgggattacaggcgtgagccaacatgcccggcctcacttcaaacatctaaagagcagagaagattaaaatacaagacagaagtaattagctgggcatggtggcgagtgcctatattcccaggtactcagaaggccgaggcaggcgaatcacttgaacccaggcaggtggagggtgtacctcgccaagatcaaaccactgcactctagcccagcaccaagccagactcctcttcaaa

SEQ ID NO: 4189 - DNA, 1017 bp, Homo sapiens
gattcggcacgcggggagtacagtggtgtgatctcggctcactgcaaccttcgcctcccaggttcaagtgattctcctgcctcagccttccgagtagctgggactacaggcacctgcaaccacgcccagctaattttttgtatttttagtaaagacggagtttcaccatgttggccaggctagtctcgaactcctgacctcaggtgatccacccgcctcaacctcccaaagtgctgggattacaggtgtgagccaccacgcccagcctcttgtgaaatttttttctcagaatagcaatagcttatccaaagaaagctagtgtacatcttccaaagcttttaaaataaaatagaggaggagttacacttgcagaatgtatatcttctgggatgcttctccctactccactggacactgtttgaaagtttgtagtttataatattcttacctaggctgtgttggtcagcttagaatatctaagtgataggataaaactaaagctgagtggcaaactgccagtctatatactgcatttagtctataggcttgttttgtttggcccacaaagcattttattatttaagtttatgccaacatttaagaatcaagaatttcccagacattcagatttctgacttcaattgaaaatctgacagtataaaccctattatattcctgcatggcataaaatcttcagttgctgaatggtgatatccacttttagaaagagtactctaccctgttctgcattcatacaacctaagccaacccgcccttcaccatcccacttctctttcaggttatctgcttaggctggtaggcatttgtgtttataaaccttgaactcaagctgctagatggtcagttgcattgtgaactgaactatctgaatgatttttcattgtaaatatatagctatagaaacactttaaattcctctttctataaaaagtgaagtagcaaaatttttggaccattcccaaggacaaacaataaaatagagggaaaatacagcaa

SEQ ID NO: 4190 - DNA, 415 bp, Homo sapiens
tttcctgctcagtaaatcttgtattttacataagataaagtaaacatagagtagaggaagaagaagtcagatctgcatttgtcttgaggtgggcagagggatgatttctagtcttgtctttgtcccttacctgtgaagatacattgtcagggtgagagaggctacctggggagataggtgaccttctctcttgcagcaatctcccaggtgcctgccctggcccaggcccagtgctaggccctgtgtagacaacgagcacagttgcatgctgcctctccttcctgctcatggtctagtgtgggagaccagcattgaacaaataaatcagcaaatagcccagcgcagacacccactgtctagcagtgatgacaaagggaacagacagctgacatcgtggcttcctccttcagagttc

SEQ ID NO: 4191 - DNA, 651 bp, Homo sapiens
tttaaatttagaagagaagaggctttaattcttataaaaggttacagcctgcaaggtggttgtcccacaggctgggaagctgccgtctagccaagaccagagacaggcgtttggaaggaggaggggttggggtaggagttttatgctgaaaaggttggctaaacatacatgttcaacaagttacaggaggagctgagtattcaagaaagtggtcctgacacaggcatgttagataaacatacatgtaacttatgaccgatgttcattttgaaatgaatagatgaaatgtattatacctagcccctatgtcaaaagatcttttcaggacatgaaggtacacaggtgtgcagtctctgtaaaccagcaagaaccagtccatggctggtggtcttctcatcaggagaaagttactgaattcagcctcttgtccagtcaaagctgtttctggtcggtggaacaggggttcagtgaatcagcatctgtgagctggatgagttgtaattgttttaatactgtttatctggaggccagtgcttgtttagagaagtgatgtggcttggctcagacccgtaacagaaactggccttgaactcctttttatcccgagaccagggctccttgagctatactgcatttgttccaaaccgttag

SEQ ID NO: 4192 - DNA, 1203 bp, Homo sapiens
  misc_feature (1)...(1203): n = A,T,C or G
attnttcaatcttctctgtttgtagacatcttactgggtggtgaataatcctctaagaaaccctctgagctgctaactctttcagggagaaaatcacaagccatcttctcaagttcccctagaaacctgtggaatgccctctgccaagcactgctctggtactggggagtggagtattatgtcttgaaagagactcctgctgtgattgtccaggggtacgttctggtctggcttggtgcttgaccttaggtctgcccacaggcttcaggctttcaactttgaaacaaacatctgtgccacacacattttgtaaatgatcccattcagtcttctagaagccttataacagaatcaatattgtttttcccattttcacagatggataataaatctgtaaaatagggataagactaggacctattccccaggattacaggcgtgagctgctgtgcctggcagaacagtatgaagtgttaacgccaaaatttgttttagctatcatatataaatcataagcatattatttggttggttggtgttagttcattccttcaatcggatgatttaaaataaatgtttttcaagtatcctctgtgatgtttcccaaaggttagcttagaaagaaaagtacttggtgaaccattcctggtgcggagagccctgtttctgctgggcttctttggcttgggccgtttcaccatctggggtcctaaaagcaaaaaaaggtttttttatatggttttgaaaactatgcaagaagcagcttaatacccaccatcttttcagggaaagataactgcttgtttactcttcaaaaacacccaaatgggactggccaacattagtagtggggaacaaattgtaaaggatggggcttggggagggagtacctaatcctcattttggaaaacagaaggttcaccattgtttgggtctccattgttcctttgagacttagtgagttgtagctctaataatgcaggattaaccaaacctacagatcaagagactttgtttttattttttgtgacagagtctccctctgtcacccaggctggagtgcagtggcatgatctcggctcactgcaacctccagcctcctgcgttcaagcgatcattgtgcctcagcctcccggggagctggaattacaggcgcataccaccacacctggctaatttttgtattttttgtagagatgggtt

SEQ ID NO: 4193 - DNA, 570 bp, Homo sapiens
tcgtttcaaaacaacacacaagtactgctccctgggggtgagggtgaggtgacggtagagatcagtgctaccctgggaaatctgacagatacagtaagatggtccctatcatagttccatttaatttgccagcctcatctgcagaatccagatggatcctggagaaaaattaaccaagtagcctctgtcgttgtcttggggtttcaccatattggccaggctggtctcaaattcctggactcaagcagtccatctgcctcagcctcccaaagtgatgggattacaggcgtgagctgctgtgcctggcagaacagtatgaagtgttaacgccaaaatttgttttagctatcatatataaatcataagcatattatttggttggttggtgttagttcattccttcaatcggatgatttaaaataaatgtttttcaagtatcctctgtgatgtatcccaaaggttagcttagaaagaaaagtacttggtgaaccattcctggtgcggagagccctgtttctgctgggcttctttggcttgggccgtttcaccatctggggtcctaaaaacaaa

SEQ ID NO: 4194 - DNA, 494 bp, Homo sapiens
  misc_feature (1)...(494): n = A,T,C or G
ttgnaaaancacattnctctgtcanaagggtaagncaaatcagtgtggactgagagcaaggtcangcaccgtgaanaggccattgcggttcctttaacccactgggaattcatgcagtgaagaagcaacacacccatgaggcaaatggctcaaacccaaagaccagaggttcaggggatatatatatatatttttttaatctgtagagatgggatctcactatcttgcccaggctggtctcgaactcttgggctcatgctgtcctacctcagacttccaagtagctgggttttctttgggctatttttttgtagagatggaggtctcgctgtgttgcccaggctggtctcaaattcctggactcaagcagtccatctgcctcagcctcccaaagtgatgggattacaggcgtgagctntgtcctggcagaacagtatgaagtgttaacgccaaaatttgttttagctatcatatataaatcataagcatattaa

SEQ ID NO: 4195 - DNA, 500 bp, Homo sapiens
  misc_feature (1)...(500): n = A,T,C or G
ttttttttggagacagggtctcctctgtcacccaggctggttggaatgcaggagttcgaacttggctcactgcaacctctgcctcctaggttcaagtgatcctcccgcctcagtcccccaagtacctgggaccacaggcacacgccaccatgcctggctaatttttgtatattttgtagagatggggtttcaccatattgggccagggctggtctcaaattcctgggactcaagcagtccatctgcctcagcctcccaaagtgatggggattacaggcgtgantgnctgtgcctgggcagaacagtatgaagtgttaacgccaaaatttgttttagctatcatatatnaaatcataagcatattatttgggttgggttgggtgttagtttcattccttcaatcgggatggatttaaaaattaaatgtttttttcaagntattcccntgttgatgttntcccaaaggtttaggnttaggaaagnaaagtanttgggngaac

SEQ ID NO: 4196 - DNA, 1310 bp, Homo sapiens
tttttttttttttttttttttttttttttttttttttcttgaaagaaacatttatttatgatctttattggtgaaataatttcaaacaaatccagaacaggttctcacactttgagcctttagtgcaaaaacactatgccatgcgggaaataaaatgcttatccagtggagcgctcccctgatgcattgaaatattaggatactcaagcagaagacgacttatgtgacagaaatctgctcataaatctgcttgaaaaagggcatgataaacctcatattaaggtttctcacaacataaatatgcttaagcaacttaattccaacttaatttcaaaacaccccaggaatcaactatccctttaaataaaaaaaataatcaatttatattcttcttaaaagaactccaacaatttaaaataagttccaattccatatatatatatatatatatatatatatatatatatatatatatatatcacacacacacacacacacacatttataacttaggtgctcttttgcgctatatactttaattcatgcaaaagtgatagaggactggacttgaggctctacagaggcctttctgagaaagctgtgtagctccttactctggcgaagaacaagggggtgtacatcttgtcaatctcaaaagcactgactgcagtctcaccagttgatttgtaagtaatgtgacaagaatgatgtatccagatgagtttgttgaacctctggtgaccactggaacatagctgtagccccacatgaaaactctgatctgcttcttgtacagggacacgacgaaaatatctgtatttatagtcaagtggtttttcttcttttttcttagttattacagcaaatactttggtctgattgtctgtgtcttgtgacaagcgatagtgacccagtagaattgcatcagtcctggtattcctagttcttaaacgtggaacaatggactgaggctcttcaggggttgtcaacatcatcacatggccatcaggaaagaatcttatgtacctatgtaataagaaaaggaagaccaaaacacaccccccacacaaagtataaactatgtccttatctattagtacctatgcctattcatagctatgaaaccaaccctgaaatcccacgggctaaagaactgctaaaacattaaaacaaatattactgactacctcttagtccagcaacaaagaaccaaagatattccatcttcctcaggggaaactgtcacacttttaagtttcactcactgaataaacgtcaaatatcgtctcactaaagttctcctctgccga

SEQ ID NO: 4197 - DNA, 1891 bp, Homo sapiens
  misc_feature (1)...(1891): n = A,T,C or G
tgaaagaaacatttatttatgatctttattggtgaaataatttcaaacaaatccagaacaggttctcacactttgagcctttagtgcaaaaacactatgccatgcgggaaataaaatgcttatccagtggagcgctcccctgatgcattgaaatattaggatactcaagcagaagacgacttatgtgacagaaatctgctcatanatctgcttgaaaaagggcatgataaacctcatattaaggtttctcacaacataaatatgcttaagcaacttaattccaacttaatttcaaaacaccccaggaatcaactatccctttaaataaaaaaaataatcaatttatattcttcttaaaagaactccaacaatttaaaataagttccaattccatatatatatatatatatatatatatatatatatatatatatatatatatatatatatatatacacacacacacacacacacatttataacataggtgctcttttgcgctatatactttaattcatgcaaaagtgatagaggactggacttgaggctctacagaggcctttctgagaaagctggtagctccttactctggcgaagaaacaaggtgtgtacatcttgtcaatctcaaaagcacttgactgcagtctcaccagttgattttgaagtatgtgacaagaatgatgtatccaagatgagttggtgaacctctgtgaccactgaaccatagtgtaccccacatgacatgaaaactctgatctgcttcttgtacagggacacgacgaaaatatctgtatttatagtcaagtggtttttcttcttttttcttagttattacagcaaatactttggtctgattgtctgtgtcttgtgacaagcgatagtgacccagtagaattgcatcagtcctggtattcctagttcttaaacgtggaacaatggactgaggctcttcaggggttgtcaacatcatcacatggccatcaggaaagaatcttatgtacctgtaatattccacttggtgccaggctctatagaaaccatcaagagactgttccccttgacgaatatatgtggttttactgatatacacgccatcaaaccgaacacgaggccgttctaaaaacatctctctccaggacgtgtacggaacaagtttaatacagcttctgccccaaactttcaagcaggccagacgccatatttcagggtctctggcacagatgtagaatcctctgcacaccagcgacaactgctccaatgatctgaggtccaagtcactagacaccacccatcggaagatgtacatcaggacctccattggcagcactgatatgtgaatctgactgctctcaagctcaggctgacacagtttaagcacagactcctgaaatgtgagttgctgctggaagtaggacaagagatctgccattttgctgtcatcatcattatcttcaatgtagctgtttcccaacgcccatcacccatctggagaccgggtataagtaatcttgaactcctatatcaggtacaagttgcatagccctacgataaaacttgatggcttcatagagagctccattttgttcttcttctactgcttttaggaagagttctcgagccttttcttcttttgcctgttcttgttttcctttggtatctgccgatgttttctggagagagcctcttgctgctctgcaaggtcgattttctaaattgctagagcttacacctggagcaagttcaaacatccactgagctcggaacatctggagttgtgcctgcagatctngtttcagcaggactttcattttcttcatcatcatctgatactgtcagagcagatgatgatgaagaaaatgaaagtcctgctgaaacacatctggaagtttgt

SEQ ID NO: 4198 - DNA, 979 bp, Homo sapiens
  misc_feature (1)...(979): n = A,T,C or G
ttcaaaatatagaataacttttaatgagccataagaaaatgctagtgctgttttaatctaaaccattaccacaatgagtttacagttagtgtaaaaatgacttgaatatatttttctaatataactctttttcccaaatcagttaagctagcatgtaaactctatggtagtagtatgggttactacatctgtcctacatattattctataccctagaaacctagcatattctagcctttaaattctaagttatttgagaaagttaagtacagcttagcaaaacttgtttattctaagctttaactcagaacaccaatcaagtaattttatcaggattggcananggaccatctttcttttcaccattgcctcagttggtntaaaaaacagaaacaaaaacttagtacctggcacagatgtagaatcctctgcacaccagcgacaactgctccaatgatctgaggtccaagtcactagacaccacccatccggaacgatgtacatcaggacctcccattggcagcactggcaaaaggaanatcatccttcagtgactctcctctatgtcattctattgtcacaactacattcccagtacattcatgctttagctctgtattgctcagantaaagcatgaatgtatttagctactcaataataataatggttcttaacatcaagacataaatatctttgttttttcagtatagatctgaagctactttttataaagcactcttttccctcataagattattttgccagacatattaaaataaatgttttaggaaaataatctatgtgtgtgtgatccatattgcatctattaacactaaagttattttcatctccttgaaaacttttaattgtcctcctctgaaaaagccccgaaccaaacaatatttaacatattaaaaatacatgaatttcttttttttttgtgacaggttcttgctctgttgcccaggctggagtctc

SEQ ID NO: 4199 - DNA, 496 bp, Homo sapiens
cttagttattacagcaaatactttggtctgattgtctgtgtcttgtgacaagcgatagtgacccagtagaattgcatcagtcctggtattcctagttcttaaacgtggaacaatggactgaggctcttcaggggttgtcaacatcatcacatggccatcaggaaagaatcttatgtacctgtaatattccacttggtgccaggctctatagaaaccatcaagagactgttccccttgacgaatatatgtggttttactgatatacacgccatcaaaccgaacacgaggccgttctaaaaacatctctctccaggacgtgtacggaacaagtttaatacagcttctgccccaaactttcaagcaggccagacgccatatttcagggtctctgtgtgctctcagcactctacgtccaccggactgtttgatgaattctcctagtttcctcaggattggactacaacacgccaactggcacagatgtagaatcctctgc

SEQ ID NO: 4200 - DNA, 582 bp, Homo sapiens
  misc_feature (1)...(582): n = A,T,C or G
tttgaaaaggccaagttaattacnccccggggcaaaaggccnaggangaaatctnaaaaggggccagaagaaattctggtaatttatattggccctatttttttttttctagtgcaattcctacattgagtactagataaaaatactgagggccattttgcgggtcaatcaaaagcaacaaagaacagatgtccatttaactaatacatggagagagagaattttccactcactcagtgtactacagttgtacctgtaatattccacttggtgccaggctctatagaaaccatcaagagactgttccccttgacgaatatatgtggttttactgatatacacgccatcaaaccgaacacgaggccgttctaaaaacatctctctccaggacgtgtacggaacaagtttaatacagcttctgccccaaactttcaagcaggccagacgccatatttcagggtctctggcacagatgtagaatcctctgcacaccagcgacaactgctccaatgatctgaggtccaagtcactagacaccacccatcggaagatgtacatcaggacctccattggcagcactga

SEQ ID NO: 4201 - DNA, 774 bp, Homo sapiens
  misc_feature (1)...(774): n = A,T,C or G
tggttctgttaataaattcagagacaccaatcttttaggaaccacatgaatcccagaggtctataaattaacaaaagacagctcaatgaagacagtgtacccacagagaaaaaagccatgcaggagtagtggtaccatccaaagtacctagaagaaattgtgagaaatatataaactagtatactagtcaaaatttttattttacaagatatgtgtttatgtcccgaaagtctggttataatgcctacttactgtgtcagtgaaaatttccatgtgccaaaaaaaaaaaatgtaatttgttacaatatctataatacttaacttttcttcttgttgcctgttcttgttttcctttggtatctgccgatgttttctggagagagcctcttgctgctctgcaaggtcgattttctaaattgctagagcttacacctggagcaagttcaaacatccactgagctcggaacatctggagttgtgcctgcagatctgtttcaagcaggactttcattttcttcatcatcatctgctctgacagtatcagaatgacaatcttcctcagcttctgcctgaggggggaaaacccaaataatgtcaggcatataaacacaccagttgccctctgcaatctacatttctcattcagccactttctatttagtaccatactgtcaacactttgtggaacccactttgagtagcaaggctgtagggggcacttgagaccttactattaatttccaaaggaaaatgagtctnaaaagcatattctct

SEQ ID NO: 4202 - DNA, 593 bp, Homo sapiens
tttggtatctgccgatgttttctggagagagcctcttgctgctctgcaaggtcgattttctaaattgctagagcttacacctggagcaagttcaaacatccactgagctcggaacatctggagttgtgcctgcagatctgtttcagcaggactttcattttcttcatcatcatctgctctgacagtatcagaatgacaatcttcctcagcttctgccatgctggcggggcggcctgctgcgctcgaggggctctccgtgccccctctgcaccgccccccggaggaaggggtgctgggtgtccgggtgtctactcctgcctgtctctgcagcggagcttagcagagttctcggtcggagaagcgcaccaggcagcggcaataactgcgggcccggcgtacggcagccatcttcgcggggcagggggccagatcggggcgcgctggggtggggcggctgccggggactcggggagtggagggacgcccgttgccagccgaggcgggggattgtgcgagcaccggagcgtcagccctactggagaccccggacgcctgcgcggagctgccccctcagctgcggaaacctgcgccga

SEQ ID NO: 4203 - DNA, 531 bp, Homo sapiens
  misc_feature (1)...(531): n = A,T,C or G
aanaaaactangtatacnagtcaaaattnttattntacaagatatgctgtttatggtccccggaaagtctgggttataantgccctactttactgtgncgaaanntttccaatgtgcccganaanaaannacanatggtaaattntggntacnaannatcntaataatacctcnaacntttcncttctttnttgccatggttcnnnngttgnaacccanaagnnnncntgcacnanggttnncaggcgtgtcngtcgcanaaanganacgcaagganggccangtnnannttngcangnccnganagngnggnnnggacgcaantngcnncnccacanncnncccnnctttnnntggnnntttcgcgggngttnancaggactttcattttcttcatcatcatctgntctggnantatcagaatgacaatcttcctcagcttctgcctgaggggggaaaacccaaataatgtcaggcatataaacacaccagttgccctctgcaatctacatttctcattcagccactttc

SEQ ID NO: 4204 - DNA, 445 bp, Homo sapiens
tttgaaattctattatcttttatctctttgatatcctttacattaaacttaattctcaagttctccaactggtgtctacatcagacttgtaaagagttatagaaattataggagtcaaaaatagtttaaaagccttgtgatatggatatatgtaagaaatactcttctttgaatagtgaaataccttagctctctagttcagctaatgtacatattttcaaagctgggaaaagacagctgtgtggatgtagagaagtaggggagaggagagggtggatttgcattaatgatggggcttcagtgggaaggaaggaaggagggaaggaaggaaggaaggaaggaaggaaggaaggaaagaaggaaagaaggaaagaaggaaagaaggaaggaagggcaggagggagaaaatagctagcttcattttagtttcaagttaaatgaaata

SEQ ID NO: 4205 - DNA, 2356 bp, Homo sapiens
ttttttttttttttttttttttttttttttttttttttttgctttgtaattagtatattaaggagacaatacatttcaagaattgcttaaattctgatacccagatttaagcatgtgaacatatgagacttttaaacatacaattaaagctattcatcataatttgctatactaccaacataactttggagcgaaagtcaaatggtttaaagtaatcctgtaacatacctaaagaacaccttcctatattacgcatgcaaattctccacgtaaaggtcttttcactttaatttctgttacccagctctgaagtcactacttgggcttatcatggtccacagacaaggaggggagcaaatgaccaggactggtcaagattatatatatatatgtatatatatatgaatggcacagcagaaggaaacacaattctggaagtgcaagccttcaagaagcagcatattatgataaacccctcctacagaaaggtatcatttttatcactgataccacaggataaattatatattacgccatcttcaagtaacagctgaggcaacagaataaatgcagaggcattacaatgaatcccacttaatataaagaactatacagaccaacacttctctacaaaatttttttttcctcattgccagttaaatacagagttttactttcatagcttaacaatgaagggtcatacactgaagccaatacatatacctagcatttcagtctaagcttgtccacgtacatagctgaagtcaattacaaggtttggcctagaaatgctaggggaacttctttgtagtttttacaggtattaaacttcatcttgcacactagcggccgcccttttttttttttttttttttttgagcttttatatttgcgtttattcttcatttaactttttataacactactatagtttattaaaacaaaaacaagagcaagtagtgagcatattatgattacagtccttcactcattcactactgcacattaaatgccagcagtgagtgttattcactggcccattaagaggtctgacactgaacaccacctctgggatgatgttcatcatcctcatatgcttctccattgtagtggcgccgtctttcctgatttggatcaaagtccaccagttctacttggtccatctcatcagtctcttccacttccttcctctcgggtaggagtttttccagcaaagacagtttatcaggagagagaaagccattctcaggaaagtttaccttaaattcgatgattaggcgacccttttcatatggtctacgataaattggcatgccttcatttagtacacacttgatatctccatgcttgacaatctgacctggatgagaggtgatgacgatggttcggttgtcaagagtagatattggcttctggaagccacacagtgcttcaacgagctgtatgtccatacacatgaaaaggtcttctcctcgtcgagtaaaaacagcatggtccttctgatctaacacaatgataatatcgcctggctccagtcctggttcttggtctccttcaccatggaatgttatcttctggccatctttcatgcctttgtcaatatgaacttctaaaatttcttctctcgaactatcttccttccgttgcagcttttacatctatctttaggactgatccgctccccatggccctggcactccatgcacacagactgaatttgctgaaccattccaggtcctatctgatgaattcttatttgcattccagtacctcggcaattgggacagcactctactgctcctttcttacctcctctaccttcacatttgtcacaaatcacattcttttgcagagccagttttcttgttgcaccattatataagtcttctagggttactgagagctgatgtacaacatttttacctctcctttctctctgcatccttcctcctcctccaaaaaacatatcaaagatgtccatgggggagccaaaaccgccacctgctccaccctctttaattgcctgttctcctcctttgtcatataattcccttttctttgcatcagagagaacttcgtaagcttgagaaatctgtttaaacttctctccttcatttgggttcttatcaggatggtacttcaaggccagtttcctataagcctttttcaattcttcctgagtagcattgggtttgacccccaaaacatcgtagtaagttgtttctttcaccatcttctactgccggtgcgggctgaggccggtgtgtgagggagcgggaaggagcgccgagctgtgcgcagccggggtagttaccgctcctccgcctctcaccgagcgttctggaaagttcccccc

SEQ ID NO: 4206 - DNA, 1142 bp, Homo sapiens
  misc_feature (1)...(1142): n = A,T,C or G
cagaaaggtatcatttttatcactgataccacaggataaattatatattacgccacctccttcaaggtaaacagctgaggcaacagaagaaaggcagaggcattacaatgaatcccacttaatataaagaactatacagaccaacacttctctacaaaatttttttttcctcattgccagttaaatacagagttttactttcatagcttaacaatgaagggtcatacactgaagccaatacatatacctagcatttcagtctaagcttgtccacgtacatagctgaagtcaattacaaggtttggcctagaaatgctaggggaacttctttgtagtttttacaggtattaaacttcatcttgcacactgaagtcatcatacatacagggcaaaatcagagcttttatatttgcgtttattcttcatttaactttttaaaacactactatagtttattaaaacaaaaacaagagcaagtagtgagcatattatgattacagtccttcactcattcactactgcacattaaatgccagcagtgagtgttattcactggcccattaagaggtctgacactgaacaccacctctgggatgatgttcatcatcctcatatgcttctccattgtagtggcgccgtctttcctgatttggatcaaagtccaccagttctacttggtccatctcatcagtctcttccacttccttcctctcgggtaggagtttttccagcaaagacagtttatcaggagagagaaagccattctcaggaaagtttaccttaaattcggtgattaggcgaacccttctacatatggtctacgataaattggcatgcctttcattagtacacacttgatatctccatgcttgnacatctgacctggatgagagggatgnacatnggtcggtgncagagtagatatggcttctgaagccaccaggctcaacgagctgatgtcatacacatgaaaggctcctctcgcgagaanacaagatggtcccttgttacacaatgatatatcgctgggtcagggcttggtctgctcctaccacgtgatgtactcttgcatcttctaggcttgcatatgactnctaatttcttctctaacttttttctcgtgcatttttnggccctggtgg

SEQ ID NO: 4207 - DNA, 534 bp, Homo sapiens
ttttaaagagacagggtttcactatgttgcccaggctgttctcaaaactccagggctcaagggatcctcctgcctcagcctctcaaaatgcggggattacaggcatgagctacttgcacctggctgaaattttacttttttatcagattttagtaagccaattgttctcaagtattcttaaagtacattacagcttaccttaaattcgatgattaggcgacccttttcatatggtctacgataaattggcatgccttcatttagtacacacttgatatctccatgcttgacaatctgacctggatgagaggtgatgacgatggttcggttgtcaagagtagatattggcttctggaagccacacagtgcttcaacgagctgtatgtccatacacatgaaaaggtcttctcctcgtcgagtaaaaacagcatggtccttctgatctaacacaatgataatatcgcctggctccagtcctggttcttggtctccttcaccatggaatgttatcttctggccatctttcatgccttt

SEQ ID NO: 4208 - DNA, 810 bp, Homo sapiens
  misc_feature (1)...(810): n = A,T,C or G
naanatnaataacaaannnanccaatnatanannaccatgntannncaanaaaaaacanntnnnancnaaatanacntaaacaagtaaaaaacnnatnntnatannnanncttaancaaaatnnctaannnaanaanannaanaaaaaaanncaaaacnnncaaatnatagnttaaaaacannancaacnanaanaatnatacaannaannnacncananaaaanatnaaancaanattaatnaaanaaactcngncanancnanaaaaantcngtnnaaaaacacaannnaanntnnttnnnaatcannnanaactnnaangggcaanaangggaacnggnaccnncccnanngaaattgcccccggtttatccaacaatttaaccttttaatcaacactacctaaaagctttacttaacaaacaaaaacaaagggcaaaatagtggagcaataattatgattaacaagccctttaactcattcacctactgcaacattaaatgccagcagtgagtgttattcactggcccattaagaggtctgacactgaacaccacctctgggatgatgttcatcatcctcatatgcttctccattgtagtggcgccgtctttcctgatttggatcaaagtccaccaggtctacttggtccatctcatcagtctcttccacttccttcctctcgggtaggagtttttccaggaaagacagtttaccaggagagaaaaagccattctcaggaaatgtttaccttaaaatcagatgattacgcgacccttttcctcgtcccaactccatgcaggccagg

SEQ ID NO: 4209 - DNA, 458 bp, Homo sapiens
  misc_feature (1)...(458): n = A,T,C or G
gcactccaacngctccctncccttaccctccctcccaccctccacaattggtccacaaaatccacattccttttggcagagcccagttttccttgttgcacccattatataataagtcttcctagggttactgagagctgatgtacaacatttttaccctaaaacaaaatatttcctcattgcaaatctgtttaagatgctggatcttatttgtgctaaaggcactataaagaatgtggcaaagaataataaaagatgagcctcacagggtacatctgttgactacctactatatacacagaatgttcacgttatcacagatgatcctcaaactgtgatgtaatcacagatgagggaaaatcaggtcagagattaaatatttgcttaagggcacagacgtggccatcttggaaatatggtaagcaaaagcattaccttcaaagtcacttgagaaaaac

SEQ ID NO: 4210 - DNA, 450 bp, Homo sapiens
  misc_feature (1)...(450): n = A,T,C or G
ttttaaagagacagggtttcactatgttgcccaggntgttctcaaaactccagggctcaagggatcctcctgcctcagnctctcaaaatgcggggattacaggcatgagctacttgcacctgggntgaaattttacttttttatcagattttagtaagccaattgttctcaagtattcttaaagtacattacagcttaccttaaattcgatgattaggcgacccttttcatatggtctacgataaattggcatgccttcatttagtacacacttgatatctccatgcttgacaatctgacctaaaaacattgaagccaagttcttccttaagtatgggcacatttttatgaggcagggaatataaagancagagcactgtcctagctcattgggcaggagtaaaacttacgtgggcaaagcaatcctgttactttcacttatggggtttt

SEQ ID NO: 4211 - DNA, 590 bp, Homo sapiens
cattcactactgcacattaaatgccagccagtgagtgtattcaacctggcccataaggaggtctgacattgaacaccacctctggattgatgtccatcatcttcatatgcttctccaattgtagtgccgccgtcttttcctgatttgaatcaaaggtccacccattctacttggttcaatctcatcagtctctccaacttcctttctctcggtaggaagtttttccagcaaagacagtttatcaggagagagaaagccattctcaggaaagtttaccttaaattcgatgattaggcgacccttttcatatggtctacgataaattggcatgccttcatttagtacacactggatatctccatgctggaaaatctgacttggttgggagttgatgccgttggtccgttttccagaagagaaaattgtttcttgtggaagccacacagtgcttcaacgagctgtatgtccatacacatgaaaaggtcttctcctcgtcgagtaaaaacagcatggtccttctgatctaacacaatgataatatcgcctggctccagtcctggttcttggtctccttcaccatggaatgttat

SEQ ID NO: 4212 - DNA, 558 bp, Homo sapiens
  misc_feature (1)...(558): n = A,T,C or G
tttttatatttgcgtttattcttcatttaactttttataacactactatagtttattaaaacaaaaacaagagcaagtagtgagcatattatgattacagtccttcactcattcactactgcacattaaatgccagcagtgagtgttattcactggcccattaagaggtctgacactgaacaccacctctgggatgatgttcatcatcctcatatgcttctccattgtagtggcgccgtctttcctgatttggatcaaagtccaccagttctacttggtccatctcatcagtctcttccacttccttcctctcgggtaggagtttttccagcaaagacagtttatcaggagagagaaagccattctcaggaaagtttaccttcaaaagaaactttcactgttcaatctgatttcatcattagctcccttagagtatcatggacccattttccccagaaaaacacatgtaaacacgtaatatttaggtgaatctgccaatctcaggttagnacaggctctnaaaaggcacagtgcatagcacactctgaactagagttc

SEQ ID NO: 4213 - DNA, 417 bp, Homo sapiens
tttgctttgtaattagtatattaaggagacaatacatttcaagaattgcttaaattctgatacccagatttaagcatgtgaacatatgagacttttaaacatacaattaaagctattcatcataatttgctatactaccaacataactttggagcgaaagtcaaatggtttaaagtaatcctgtaacatacctaaagaacaccttcctatattacgcatgcaaattctccacgtaaaggtcttttcactttaatttctgttacccagctctgaagtcactacttgggcttatcatggtccacagacaaggaggggagcaaatgaccaggactggtcaagattatatatatatatatatatatatatatatatatatatatatatatatatatatatatatatatatatatatatata

SEQ ID NO: 4214 - DNA, 771 bp, Homo sapiens
  misc_feature (1)...(771): n = A,T,C or G
anatcttnaatagtctcatgacattactatttaaataaacatgaatttcatccaaataattttaatcttcttttntgtttttcctttggagacagggtctcgttctgtcgcccaggctgtagtgcagtggtgcgaatcttggctctctggaacctccgcctcccaggttcaagcgatcctcccgcctcacccttccaattagctgggactacagatgcccaccaccagccccagctaacttttgtatttttagtagagacagggtttcaccaagctggtctcaaactcttgacctctggtgatccgcccacctcggcctcccaaagtgctgggattacaggtgtgagccactgtgcctggcctattttattcttatttataacggttttctcaatttgtagcttaaattgaaagtacttgcaaaatgagaataatttgtctctactacataaagaaataatttttctaccccaaatgaagataaagtcacttctcacacaataaacattaatttagcagaattaagtttccccttatggcatctgatgcttgaggattaccaaggatccatgcaatagagcactacattttggaattagctgagaatgatcccaaatttcctctagtaaacataattttggccacaaatgaagacaaaagataaaagtaattaattctagaagaacacctctcgtcagaaattaatagatcttatttaggtgtctaggaagcatttaactacatagaacttatagggaaaatggccatatt

SEQ ID NO: 4215 - DNA, 2138 bp, Homo sapiens
  misc_feature (1)...(2138): n = A,T,C or G
gganttgaaggattgtgatgacaatctctttgcagcagctatgtatggtttatgtgaagtatccccacttattcttgtggagcaggtttggtgagacagcagtaaccaaatgacatgccaatattactggtgcaactggtattctacaaatgcataaggaacacatagacgacttccttttaggataaaatgatgcttctttcactacctttttgtggtagctgtgggcttccaatagcaactgtttgacagttatataaatcttgcatgtgtattcttaggtttgtgtcccttaagtactacttaattctcaacgtaggtaatgttattccttataccctttcagcgttctattttgattcaaaacaattgattcaaaacaattttgaatcaattttctattttgattcacaaacaattgataattccaataaaaaaagcataaacactgaattcttcagtgaaccaaagcaacaaataatagagaaaacttcttgaaactggagtgtgggaaaacttcttaacagaacgtaagagttaaaggtagtgagaagtgtgtggtgtgtgaattctttagtggtaaggggaaatgtgggctaaatccttttctttcatgaaactctcattctattttatatttctggtttgttcttgttcccatgtgagaaaacatacagtttctgaaaattcaaaatggtcatcaatgctttggactttacataattatgtattagagaaggtgcaactgtacattacttaatatactatgaacataatagaataacaaaaaaagataacaaagagatgcaaacttctggataaatcagataaatggtgctacagaggaatttagttatttcagcttaattatttgtaaaaataataatcagtgactaggtaaagatactgaatctcaagaaaaatatcttgacccatttatgtctagtgttccattattggaacgctaagcttatgggagttatttagagcctactgctcaaggtcatcaccaaggtctggttgcaaaaattcacaaaattgcaacctcaggcataaatggcttaagcccaagagatggcactgaccataaatggtggcttgtgtgtgaagggtttggacttcaagatatactaacacctagaaaactaaaagtgcaattgacccccaattactattttagtttgaggtatcaagggcatttgccaatctcttatatgtagcttctagagttgtgctgtccaatattatatccactagccaacgtggcttttgaaattaaaattaattaaaattaaattaaaaatgtaattcttcagtcacaccagccacatttcaaaggctcaatagccacgcctggcttgtggctaccatattggataacaagaaacacttccgtggttgaagaaaattttaatggacaatgctgtgtttcatttgaattcgttgtccttgaagaaaagggaagaagaggaaagaaacaagatttggtagctcttgggcatatccaagcatttttgattttagagaggccctatggagtaatgaaaaaaatacaagctgacacagctttaaatccccactgtgttatcttgggaaaatcacttcaacctccttgagtctcaatttgcaattttggaaaagaaaaacaatttttgtcctgtctttcttgcaagattattatgcaacctgattaaatgtacagatgtgcagactcttaaaaaccttatgttaatgtaacccatataaagtacgacttttggtcgagtaccagcacaaatttgcattcaaaggaagaatagttcatcagtgccaaaaagccttccaaaggtaattcagttccatcacgtattctggaggaaaaggagggatggcattcaaaacacaaagcaaaattgcttcagtttcttttctgcccatctgaatatttcctttagtatttgtcccacatgacatccatcccatgtatttatccactctttcacaacattgcctatgaacatccttcaactggctcagttctttattgcatagagccacttagcttctctagtttcttatgatttcctattttacacttaacagcaaaaggaggcttccatttagaaggcactatctcaaacataaataatttcatattt

SEQ ID NO: 4216 - DNA, 411 bp, Homo sapiens
ttttttttttctctcctgcttccctcatctgttctcttccaaagaagctggtccttagcctgtattgcggacgagctttcggcgaccagctggaccctgggcacccttcttcgaacaatggcttttaattctcagactagaacgtttaggattacaaaagaaactggttcttttcacattcttattcttgtgatgtagcattccgcatatatatatatatatatatatatatatatatatatatgtatatatatatatatatacatacctacatcaatccatgccattagacatgtataggaccatgcatggtgatctcctccagacaagagtaaatgctggtgcagaacaggatttgagtttgatgtcttgcatacaatgtgatcccactgtatgactacacaaatgttg

SEQ ID NO: 4217 - DNA, 2374 bp, Homo sapiens
aggcgcccgcccgccgcgcgtgattctcgcctcgccgcagcccagccctgcgcgccttgcccggcggcccccgcccggccgctccgggcccctggccccgcggagcgatgctgctgctggctgccgccttcctcgtggccttcgtgctgctgctgtacatggtgtctccgctcatcagccccaagcccctcgccctgcccggggcgcatgtggtggttacaggaggttccagtggcatcgggaagtgcattgctatcgagtgctataaacaaggagcttttataactctggttgcacgaaatgaggataagctgctgcaggcaaagaaagaaattgaaatgcactctattaatgacaaacaggtggtgctttgcatatcagttgatgtatctcaagactataaccaagtagagaatgtcataaaacaagcacaggagaaactgggtccagtggacatgctggtaaattgtgcaggaatggcagtgtcaggaaaatttgaagatcttgaagttagtacctttgaaaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtgaagccatataatgtctacatcacagttgcttacccaccagacacagacacacctggctttgccgaagaaaacagaacaaagcctttggagactcgacttatttcagagaccacatctgtgtgcaaaccagaacaggtggccaaacaaattgttaaagatgccatacaaggaaatttcaacagttcccttggctcagatgggtacatgctctcggccctgacctgtgggatggctccagtaacttctattactgaggggctccagcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctctctctctctctctctctctctttctttctttgtgtattttattcaagatgagttggacccattgccagtgagtctgaatgtcactgacagccctgtgttgtgctcaggactcactctgccgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttcatttctcattcatggggaaaggcagcctccttaaatgttttctgaagagcggtaaaatctagaagcttaagaatttacagttccttcaataaccatgatgacctgaagttcacctatcccattttagcatctacttgtttttcccatctcttcctttccaattttgcttatactgctgtaatatttttgtaaaaaaaaaaaaaaaggaaaaaaaagaccagctaaaattttcgacttgactttttaacttaactcatgaattaattaaagcaaatgaaaaaattaaaaagtgtgactttttctcggagcatatatgtagcttttaggaaaggctgatgatggtataaagtttgctcattaagaaaaaaagacaaggctgattttgaagagagttgcttttgaaataaaatgatcacctgttctttatgtgactctcccactgaacctgcagacattatttttataccacatgctaaggaagcccactcatctaactctgtagccctg

SEQ ID NO: 4218 - DNA, 448 bp, Homo sapiens
ctccctccctttcttccctggggaatttattccaaggggggttggccccattgccaggggatctaaattcacttaaaccccgttgtttggcccaggactcaattttcccctgggggaaacccaagggctcttccccctcttgaaccccaaaaggctacgaggggaccgggagaggacattccaatgggaagtaaagagatattttccagtaggaaaagcaatgctttcttgtcttgagactcaaatgcttagggaacgttacatttctcattcatgggaaaagccaccctcctaaaatgttttctgaagaccgttaaattcaggaggctaaggatttaacggtccctcaaataccctggtggcctgaaggtcccctaacccaatttaggaatcaactggttttcccaatctttcctttccaattttgcctaaaccgctggaaaatttt

SEQ ID NO: 4219 - DNA, 270 bp, Homo sapiens
  misc_feature (1)...(270): n = A,T,C or G
gcttaagcttcnagattttcccagttccttcaataaccatggtgaacttcagttcatcatggttattgaaggacctgtagttcaccnatcccattttagcatctacttgtttttcccatctcttccttnccaattttgctaannctcctgtaaaanttttgtaaaaaaaaaaanaaaggaanaaaaagaccagctaaaattttcgacttgactttttaacttaactcatgaattaattaaagcaaatgaaaaaattaaaaaaaaaaaaaa

SEQ ID NO: 4220 - DNA, 266 bp, Homo sapiens
tgcggccgcgtcgacgcagtaatgtcaacataatgaaccatcgtaattcagcctggcagaggtcacaacagctctagttttcaccttcatggtgaaggatgatcgtgttgtgggaataaatagacctggacttgattacaagtgacatttgaaagtgttgattcagattgtcccgtcgcttcaaaatggagccctagtctttaagcacagtggtgagataagtattattaatgacaggcattagttaggataaaggcaaaaaaaaa

SEQ ID NO: 4221 - DNA, 605 bp, Homo sapiens
taacataagacaagacaaaacgaggcaggggaacaatcagatatgcatttgtgtctgttgggcaggggggtgactgtatctgtaaagataagctatcagtttacattttaacagaaacaccttagggtaaagatcttgcggctcactagaaattttcttgtgggcaaaagatgggggaggtatgtagcttttcttcttgtagccatcttatttaggaactgaggactaagctctgaattttttatcttgcccaaatttctatctaattgtttgaaggggtcatgccctacaaaccataaattctcatcagatgggttttatttgaccctatagatcgtgacttactttccaatctgactctggcgtaacattatgagacaagaaaaaaaaaatcaaaatatttaacaccaaaatatattttcttgccatgccttgaaattgccctgcaaaagtctcttgtgggaaaaatgtacattctatagacaatcccctttcccttttgttttccttcctacattccagatccaggagataatcaatcaactaagagccaggcacctttttaagtccagtaagaggaaacatttttaacacctgctgtctct

SEQ ID NO: 4222 - DNA, 787 bp, Homo sapiens
tttagttaactcttgttttgcttgatattcgtgaatgtttcagcttttcatgagtcctgtactattttcctttattccaaaggttacaatttctaaagctatcataaacctatatttcagagcacctgttacagttctatagcttattagaaaccatcttttgaaaaggattaaaataggacaacaattgtctgtgaatagcaaaatgtccagggtaattacagttagaaacacaattgacaaaaaagtttggttatctccctaatggtttacagtaacttaaaatagcaactaaggactaagctctgatttgtatcttgcccagattcctttctaaggagtctggggagtcatgccctacaaaccataaattctcatcagatgggttttatttaaccctatatattgtgacttactttccaacctgactctggcataacattacgagacaaggaagaaaatcaaaatattttaccccaaaacatgtttctttgccatatcttgaaatggccctgcaaagctgtcctttgtgggggaaaatttgcatctgtaaagaatccctattaacatagctagatctttttcttccaggcctgtcctaatcctgaagaggttatctaagagtctagcaccttttaaaggtctgaacaggaaacatttgtcacctattgtctctaagggcagccactgtaagacttcaaaagaaccttggctccacaatcttttatcttaacctgaacattccccttcttgtgatctcaggtctttagacaaactcaaccaattg

SEQ ID NO: 4223 - DNA, 943 bp, Homo sapiens
  misc_feature (1)...(943): n = A,T,C or G
tctgttttgttttgtttttgacacagagtctcactttgtcaaccaagctggagtgcagtggcnaatctcagctcattgcaacctccgcctcccgggttcaagttgagtctcatgcctcagcctcccaatcagctagaatcacaggcgtgtgccaccatgcccagccaatctttgtatttttagtagagacggggtttcgccatgttggccaggctggtcctaaacttctgacctcaagcgatccacctgccttggcctcccaaaatgctgggattacaggcgtgagccaccaccgaccagcctaaactcttgatttttttaatcctgcccaaattcctatctaagggatctggggagtcatgacctacaaaccataaattctcatcagatgggttttatttaatcctatatatgatgacttactttccattctgactctggcataacattacgtgacaaaaagaaagtcaaaatattttaccccaaaacatgtttccttgccctattttgcaatttcttccataaaggacagcattttcccccaaaagctatcctttgtggggtaaagatgtgcatctgtaaagaacatctattaacatagctagatgtttttcttccaggccctcccgaatcctaaacggattaactaaaagtctaacaccttttgaagatctgaataggaaacatttgtcatctattatctctaagagcagccaccataagacttcaaaagaaccttagtctccactatcttttatcttaacctgaacacttcctttctatcaatcncaggtcttcagacaaactcaaccaattgtcaactagaaaatatttaaatttacctatagcctggaagccnccacccccacccctgtgcgttgtcccgccttcctggaccaaaccaatgtatttaatgtatttgactgatgtctcatgccaacct

SEQ ID NO: 4224 - DNA, 1930 bp, Homo sapiens
tttttggaaaatcagcttgctggagccatttattcagctcagctcgaggggtttaattgaaaacagctgaggcacactgacatcaccacaggcctccagactgaaagggacctcagaggaggcgcgctggcttggaggagggaaagcctggcttcaaaagccagagccagtgaagtgaagttttatccgaggaggaaggttttgctgcaaaaatagttcctttagtatgtttttaaaaaacaaagaagcaagaggagctgagcaggcatatttaagagcttacaagagtagggaacagtgaagaactcactgaaactctgaaagcagccttggataggctgtgatgagcaagtgaatgtttttttttttttttttttttttctgttatttcctaatttgctgccattttatttatttatggttggagtcttctccccttagcactcttctgtcccccatatttggtgctgaacaattgctttgtgcgattgcgtttctcaggtacatcctgcagcctcctaccttgtgctgcagagacaacatctaatgcacagctgggctccgggacctggtgctcctggtgtggatggcaaatgaagaactgtatctcattttcatgcaacttgtacctatttgtcccactaattttgcaaagaaaagaagcagagagaggaggaggatgccctctgtttgcccacattagtgcagatcagtcactggaggacctgcttctgggaggatgaatagcccatgtggaggggccctaccatcaggtggtcaggaaagcttggtaaccaggccaaaagcatcgtcgtcagtaccagaggatgcttggtgaggtgactcaggcagggagggtggggtgaaggctcagttggcctaaggccaggatataaagtgagtgacgtagcatttttccaggggaaagtgtccttacataccccatccaaaggtttaatatgactctaagcagcaggaccagctcctctggtgacagaggaggcctggaaggggcagcactcccgcagggacccctccactccttccctgtgtggccctgggccatctgatttgcttggtttcggcttcttgagctgtcctgatggttccttcacactttaacgttctatgattctctgactagccctaacccttaagtggcagtgggaatgtcacagcctctctgtggggctaaagattcaatttctgctgatacccccctacagagtctggagtgggtgttggtggagccaggcgagtctctttagtgtgaggcctggccagggaggaatgtgacaggtggggcaggtgatccttcagaggagcggggccccccagagaccttccaatcctgccctgcagagccagggtgcaagatgacgggccccaggatgttttaaggtgaaaaaatagtagatctgggtgattatttctccgttgtggttttcaaaatgggcaaaccaggttcccattaagccaactgactcaacactccacttctttccctgagccactccctgctctctcccccaaaatcttctttgaaatcttgctgccattccatcacattagcaagttgacactgtggtgaggactaaactctgattttttttatcttgcccaaattcctatctaaggggtctggagagtcatgccctacaaatcataaattctcatcagataggtttcatttaaccctatatattgtgacttactttccagcctgactctggctggcataacgttatgagacaaggaagaaaataaaaatattttaccccaaaacatgtttctttgccatattttgaaaaggccctgcacaaagctgttttttgtggggggaaaatttgcatctgtaaagaatgtctattatcgtagctagatctttttcttcctgaccctcccaatcctaaagagatgaactaagatc

SEQ ID NO: 4225 - DNA, 414 bp, Homo sapiens
  misc_feature (1)...(414): n = A,T,C or G
tcagacanccctaggaatgagccttcctagcgccgagggacctgctgctgttgttggcctgcacatgcattctatggaatgctttttggccaagcgggggcactgaggactaagctctgatttttttttatctcgcccaaactcctttctaaggagtctggggtgtcatgccctacaaaccataaattctcatcagatggattttatttaacgttgtgtattgtgacttactttccaatctgactctggcataacaagggaaaaattcaaaatgttttaccccaaaatgtatttcctngacataccttgaaattgccctgcaaagtttcttgtggggaaaaatccagagagagagagagagagagagagagagagagagagagagagagagagctcgtgcccgaattcctggca

SEQ ID NO: 4226 - DNA, 369 bp, Homo sapiens
  misc_feature (1)...(369): n = A,T,C or G
ttctcacttccctggctccctgttccgagttatccctgagggctaagctctgatttttttttttttttttttatcttgcccaaattcttatctaagtggtctggggattcatgccctacaaaccataaattctcatcagattagttttatttaaccctctatgttgtgacttactttccaatccgactctggcataacattatgtgacaaagaagaaagtcaaaatattttaccccaatacatgtttcttggccgtattttgaaatggccctgcaaagctgtccttttgtgggggggggggggggggggagttcncatctgnaagatctccattaaatagctatatcttttcttccggcccctcaatcc

SEQ ID NO: 4227 - DNA, 343 bp, Homo sapiens
ggtcgaccaactgccagctgagattagctgcaggtgagcactacgtgagagcagagcgtggggtctcttgccctagggaggtgctggtggctgtcacacaagggagattgttagggaaggaaaacaacaaaagcataagtcattggccagtgactttgggcatttgctggtgctggaagggatgaagtttgaggtaaactcgaggtcttcaaatggcccaattgaaaggaggatggcatttgaagggtcccagattccactcacggctgaaaaaaaatgaaagaaagagagagagaaagaaaggaaggaaggaaaagaggaataagaaaaaaaaaaagttttg

SEQ ID NO: 4228 - DNA, 739 bp, Homo sapiens
  misc_feature (1)...(739): n = A,T,C or G
ttaagctctgaggaaatgttaagtgccttaaaatagctaaacagggtttattctatttggccccagagatactaggtaagtccaacggatagaaattataaggaggcagctgttggttcaggataaggaagtttttatttgcttgtttgaagacaggttcttgctttattgcccaggttggagaatagtggcgagatcatggctcactacagcttcaacctctcaggctcaagtgatcctccttcctcagtctcctgagtagcagggaccacaggcatgtgccaccacacccggctaattttttatttttagtagagacaaggtctcactatgttgctcaggctggtctcaaactcctgggctcaaccggtcctcctgtcttagctccccaaagtgttgggattacaggcatgagccacgtcgcctgaatactgcccgaccagttttttttttaatagtttaaaatggtctggcttgttagggttaacacctggtccgtggaggcattcagaaagaatctgaatgcctgttggtcagggaagctgtagaagggatntctgtattggaaagagattgatctcaggtgcggttcaactccttcttctagagtttctctaatgatatccttttccctgtctcctttcagacagacgaacanattctgaaacgtgtgcggatgaagattcgaaataaaagatctgctctagagagccgcatgaaaaagatggtgatgctgggg

SEQ ID NO: 4229 - DNA, 691 bp, Homo sapiens
ggttgcagtcagccatgatcacgccactgcactccagcctggagacagagtgagattctgtctaagaaagaaagagaagaaagagagaaagagagaaggaaggaaggaaggaaggaaggaaggaaggaaggaaggaaggaaggaaagaaggaaggagagagagagaaagaggagacagaaaggctgctttaggactaagaggtaacgggagatagctgctttaggactaaggtaactggagatatcagatatcagaggtcatatgtgggtagatggagtagttccaactcaataaaagtagagagttcttgctgagcccctctggcattcagttaaataagattccagaaaagcaacatcttaaaaataagaactacacccttgaaaaggagccctgccctaaaattacaaataaagctagaagaggatacctactcctaacaaagtactgaaacaagcctaacaggttcaagatcctttagtaatttaattgcctgccagaacaaagctcataacttttaaagaaaggtaacataattcataaccctacaaaatgtatcacacacaagtacagcacatcaatcaaaactctctagaacatgtgaaacaggaaaatgtgacccaaaataaaaacatggtaaccagatattgatattagcaggtcgagcgccgcgaatttagtagtagtagt

SEQ ID NO: 4230 - DNA, 561 bp, Homo sapiens
tttttttttttccattttagtagagatggggtttcaccatgttgactgggccggtcttgaactcctggcctcaagtgatctgcctgccttggcctcccaaagtgctgggattacaggtgtgagccaccacgcccgaccctcttcttggtagcaattaaactcccctggggaagtctcctgcttatgagatatgaagacagaagacaggaagccgcaatcccaatctcaaatatcctagactcggctttgccccaccaactttttaaatagcaagattaatccaactgtactctcaattttgcctggccaattcttcaggacccactccctcgccatctgtgaagggtttcactgggggccaattcaagacctggccacctttcaacctcacattctgctgctcatgagccccactcacaggggcgcattcactatgagtttcagttgaagaacccagcctttgaggatctagatgcaggtttcctggtagaaagatctacatcaatgctcacaaaagccaggcaaactggtaccaaccagtcagatcagcactgtgtttgg

SEQ ID NO: 4231 - DNA, 471 bp, Homo sapiens
cagtgagccaattcgaggccctgtctaaaaaaaggggggaagggagggcagtaagagcaagataatgtgagaggcctgagaaacaacaaaggcccaggattgaaagaagacaactctgtcagcctggcaggaatgggaaactctaaacttgagtaaggcatttcaccttgctctgttcagtgtatcttgtttacaaattggaaatcttagttgagttaaaacactgcagtattcttcaaagtgttatccctggctacttgcaatgagtcactttgaatgcttgtggaaatgcttgggccaggcacagtggcttatgcctgtaatcccagcactttgggaggcactgttgggaggatcacttgagcctgggagtttgacgctgtgatgagctgtgatcaggtgactgcactccagcctgggcaacacagcaagactctgtctcctaaaagaaaagaaaaaaaaaagtcgacg

SEQ ID NO: 4232 - DNA, 5512 bp, Homo sapiens
  misc_feature (1)...(5512): n = A,T,C or G
atatttatttttggtgtttctttgagaaggaaatccatcggtaagtttaaaatgagcggattaaaaaatgtggcataccattctcttttcaagaacatatgtgagaagtggtaagaaatacacatggttggccaggtgcagtggctcatgcctgtaatcccagcactttgggaggccaagacgggtggatcatgaggtctggtgttcgagaccagcctggccaacatagtgaacctgtctctactgaaaatacaaaaaattagccaggtgtggtggcaggcacctgtaatcccagctacttgggaggctgaggcaggagaattgcgtgaacctgggaggtggaggttgcggtgagccgagatcgtgccactgcactccagcccgggcaacagtgtgagactctgtctcaaacaaacaaacaaacaaacaaacaaaaacatatgggaggggaaaaaattcaattttgcacttgacaatgattacaaaatcccttattatccttaacatccaggaaaatactcactggcagtttatttccattaagaaagactttgacatctttggtggatccagcaatatcatatgctcttctgaccattagtgcaacaatatctttgtccaggctttgcattttaaacttagacaaatcaggctgaaaggtgatacatgtataatcttctccattgaagggcttgagttccatctcaccagctcttcccatattatccatccatgtctatggaagtaaagaataaggaaacatgaaaaattcaagtcatctcacaaactggaagtaaataacataaatttatgagtcctaataacctaatatatatgcttataattttccatacttcaatagcttataaattatgttaaattaaaccaatcattaatgccattataaatggctatactactaccatttatcattaaggtacaagacacttatttacttgcctgtttgaacattttcttgtattctctactggctgtttccacagtaaatttggtactgaatatgttacacaatttggctccatagccatttcgaccacctgggcaaataaatatgaaacactattttattgttactatctcattgacagctttatttcttaatcactggcagagctattcaattatagagatttatttccatatctttaaccctcatgccacagacagtcatttaaatatatatatttttagcaacaaatatgttatttcccctcaatactctacctgtcactttcttttcatcatcatcatagttactagaagttaggagctgtccaaatatgagagctgggacatacatcttttcaactttgtgttcaacaacaggaataccttttccattattccatatactaattaaattgttttccctaagaaaaaaaagattgaaaattgtatcttacaacacatcaaatcgaatgcttaacatttaaaaatatttaaatactattatttctaaaatatgtatattcaggctgggcgcggtggcctgtgcctgtaatcccagcactttgggaggctgaggagggcaaatcacttgaggccaggagttctggccaacatgttgaaaccgtctctactaaaaataaaaaaaattagccaggcatggtagcgcatgcctgtgattccagctacttgggaggctgaagcaggagaactgctcaaagtgttggggttatagatgtgagccaccatacccagccctcaatttttttggcacttttcatatataccctctgaaattcagcaggaacatttcccaccatgcttagttcctgacattcctgaaataggagtcaagaggaaaaaaaaaccttttccaacacctgaatagacactgataatgttgaaaaaatacaaaattttaaaatgttaggataaacagagggaaatgatttatgcccaatggaaagaaaaggacaatctggaaacattattatacaccactcccactccttttttgagacagcatctctctctgtcacccaggctgcactgtaatggcaggatcacagcttantgcagtcttgacctcctgggctcaagcaatcctcccacttcagcctcctgaatagctgggactanaggtgtccatcaccacaccgggctaattttttgtatttttagtggagacagggtttcaccgtgttagccaggatggtcttgatctcctgaccttgtgatccgcccgcatcggcctcccaaagtgctgggatcacaggcatgagccaccgtgcctggccctagctcaacattttttaaagactatgatattgagtccttaggaaaatccaggtatactttgtcataatcaatcagactaacaaaaaagtgaaataagcaccctgatcacccactaagggacaccccgcatttataagcagaaatgtcagatcaaattattctctaccaccacctactggtttactgtttgaatagcatcatgagaaaaagttaaaactccagatgccagaatacttaaagcaattactgaaggtgcttgctcaaatatttagggattagatgtcgtgagtcctgtaatttattttgaaatgatccagagcaaataggccgcgtgccatggcacacacccataatgccaacactggaggattgcttcaggccaggagttttaagaccagcccaggcaaaatagcaagaccccttcctttaaaaaaattaaataattcaaaaaaagatggagaaaatatggacaaaacgttggcaactgttggatttaggtggtgggtatccataggtttttcattttagcattctgcttttgtgtacttttctcaacttctgtttaggaaaagccaacttcaccagtaatcaaaatacatgcagctaacaatagcaacgagctacataacaaaaactaagcaaaagacgtacggatcaattgtgactctaatacaagacatttttgggtccctttgtttgttgtccgcagcattaactgaaagaaaataaaatatacatttgtaagaaattagtgttttaaaaaacattctgtaactctaagtaagatatagaaaaaaaagttcccaaacagcacaggagtggcattaacaaggtgttaatttagcaatttttgtccatagtactgtttctacgagaagctcaacctcctgggctccaggaaaccagctcacctttatcaactgattgaaatgacaggagccctggctacagcaggtttggtaaaaatgatactttttgtttttacttttatcttttttaaatttttatttggaatgatacttcttatgaaagatttgaccagatctttatattaaaggagtttactcacctagaatctcatcaaagattttgtacaaaccaggaacaaaagtgacttccctatagttaatgccaacatcttcatcgtaaacccacatttgctagaaataaggcaaagaaatactgttatttttattctatattcattgttctgttatcatgattaccataaagtgttcatattaagtattaccatatttaggccagttccagtgacactcagtacatgagagatacagaaaggtcacactcagtacatgaaaggtacagaaagaagagtatccatttcaactactaggttaactgcctttgatgagcttgattttacctgggtcactaattccacagaaccaatgtaggtgtctgggcggagcaaaatatgttccaattgtgttttcttttgatagattctttcaacagacagtcttttcttagcatcttcatttttctttattttgttgacttgcatattttcatttacaggctagcaattaaaaaaaaagagagaaagaagggaatttttaatcataagtttaccctaaactaggaacaaaatgcctaccatagtgagatgtcaacatgcattgcaatctgttagtaggcagtggtggagttgccagttttgtacaaataggacaatttaaattcgctgcggccaggtccccaggtgtcaggttaaacagacacatattatctcaccaagtgggtctgtctggaaacctcttttcttgagcaacatggtagatgtcatcaataaaatacacccacttctttcagttcctgcatacattatttaccgagtgcctattattataaattatttacggtgtcccgagcacacgacaccgtaaataattctagttcggcagcagcagtttgggcggctatccgttcaatcccttggccacctgagcgttgtgaactcaggaagggggcgcttttgtaagctggccagctgctccagagaaacactgtgctaggctctgccctttccaagatcggggacattcaagaccgttttcaagcagcgggcaggaggggaaagcatctgtacgcgcgactcaataacgtcgcacccgggccgctgtaacatggatccactacgggaccaacggactcctgcccctagaaacagggcaacaacgcacgacaccctggaagccgggtcatacttcactactagcaccagaaggggcttccgcctctccacgatcaccccggaaccgggaatggagaatatgggctcccaagccggtcgccggcctgaccgcagccccagagcttcacccgtcacgggcggccagagagatgcccgggccgcgcggaggctccaccgccagtcccccccgcgagccgtacctgcaatggtgacacttccatggtgacggtcgtgaaggggctcaagaaccctgaaagcgactaaacaggcaggaccccacgagaccacccccgaccaagccgcttctccacagacgcgcgtcggttaggagagctccacttgaaccttcctttagcccgcccgaagcagaccagccaatccctgactcgctctcaccgtctccgtccagaagaaccaatcgtagcttgccttttatatccacctatgaacggctgagttggccggggtttgtttgaataaaccaatcaggttagggaggcgggactagagaggcttcaaaaggcaccactcggcgtcatagcggagagattgacagggaatctggccaatgagaagggctcacttgttttctcgtgcggaaagcttggaagagatgggctttggaagcgggaaggggtggcctgaggcaaaagtgtgcaggagaaaagcaaaggatgtttattctccaggaactgccaatctatttaagatccctgaaatctaaaaactgtcctctgttctgacgttgttagcgaggggaatgggagccttagcttcgttttcctgaggaaactgagtgccggctttctggacaggcagcctggctgcttggttgaagcgaacagattctggcatctgcctcaaccccgccccctttaccctcgaattcctttttcaaagaaataaaagtaggctgtgtgcggtggctggagtctgtattcgcagcacattgggaggccgaggcgggaggatcgctggagcctaggagttggagaccagcctgggcaacatagcgagaccccgtctcta

SEQ ID NO: 4233 - DNA, 2103 bp, Homo sapiens
  misc_feature (1)...(2103): n = A,T,C or G
tttttttttgcaatgtttagaacattttattaaagtacaaaattgttggaatttagctaatagaaaaacatagtaaatatttacaaaaacgttgataacattactcaagtcacacacatataacaatgtagacaggtcttaacaaagtttacaaattgaaattatggagatttcccaaaatgaatctaatagctcattgctgagcatggttatcaatataacatttaagatcttggatcaaatgttgtccccgagtcttctgcaatccagtcctcttagaaattggtttctctctttgggagattcagactcagaggcagccagaggggacaggtcaagagctgaaataatcacataactactctaattttcttcattctattgactgtgtcaagttatagacacagccaaagtgtttttcttcggcctctgatgatttgagaagatgaagaacatgagcaatttctcattgcttaaagaaaaacttggcacataagaggctgagtgtagtagagtatctgtactagaaccataaagttctatctgatggtaaattatgtataaaactaagataaaacagataattatgctctatctcatatctactgaaagtagaaaaggaggaagagtgacacttttaaatcaaactgctctagttttagcttagtggatgggtaataaacacactgctttacgctgaagtgatcagatagctatttctacagttcagaagaacttaaaaatcaggttttaaagacaaaagaagcagactcaaaacacagacaaagcagagaagaaaacaatgcccatgagatggtcactatttagacagtattataaaaagctaaagaacacttgggctttacttcactttgatgtcttgtactaaaaacaccttccccaaactaaattcagaggggaggaagttaagagcttcaggtaactttaaaaccagtcttgggcttggtaagataattacttaaaataatcgcctcacattttaaaacagatcatcttcatctgactcttccaggtactttataggtttctttgcccgtacagattttgcccgaggagccacagctgagtcaaagtccatatggaagtcatcactctcccccttggatttctaaaagagaaaagcccaggtaacttgcacattgtaaatctgacaacataattgtaatgtaaaaaaatgtatcaagacactatattcaaggagttttctattttctaccaagtaataagaagcagatctaaggccaactcttccattggccaaataagtggcatatttaactttgttaaaactaaatatgtacagtaaaagctaacagaatatgagagttaattttcttaaagatatgccaaatttttaagaacaatggcttagttacgtgtttcagaacatctacagcaaaaggactgactaggatcaacactcaccttgcttgtgactgctttcgaaacaattttctcaaaattagagtcagaatcatcagaagtggatggcttccttttgcggcgattcttggttttggcaggatcaggcttttgagagacaccagaattcaaagctggatcccttttagttccttttggggcagccctttttttggcaccggtagtggaggtggaagactgacctgcaattcaatacaggcatttgtcacagctgctctttttttgagatggggtctcactctatcgtccaggctggagtgcagtggtgttatttcggctcaatgcaacctttgcctcctgggttcaagggattttcctgcctcagcctcctgagtaggtgggattacaggggtgtgccaccacacccggctaattttttgtatttttagtagagatgggattccaccatgttggtcaagctggtctcaaaatcctgacctcaggtgatccaattgcctcggcctcccaaagtggtgggattacaggcatgagcaaccgcgcctgacctagttacagccanttttagatgattgttctcattgcgaacttttttcagcaangtgatgactgtatatttaacatagggaaagacaatttaagagaggtggaaacngagnatcaaagtatttttaaacatct

SEQ ID NO: 4234 - DNA, 4792 bp, Homo sapiens
aaagctaaagaacacttgggctttacttcactttgatgtcttgtactaaaaacaccttccccaaactaaattcagaggggaggaagttaagagcttcaggtaactttaaaaccagtcttgggcttggtaagataattacttaaaataatcgcctcacattttaaaacagatcatcttcatctgactcttccaggtactttataggtttctttgcccgtacagattttgcccgaggagccacagctgagtcaaagtccatatggaagtcatcactctcccccttggatttcttgcttgtgactgctttcgaaacaattttctcaaaattagagtcagaatcatcagaagtggatggcttccttttgcggcgattcttggttttggcaggatcaggcttttgagagacaccagaattcaaagctggatcccttttagttccttttggggcagccctttttttggcaccggtagtggaggtggaagactgactttttgctgctgtcttcttcactgtcacattctttttaggaactgggtttgtaatttcagtttcatctgggaaatgtgtagcaggagggcttgaagacagtggtacactgcccttaacatcatcagcttcaaggtctgacacgacacttttctgtggtttcagttctttgttactaagttttggggaagttttggtcttaggtggactagcatctgatgggacaaaatcttcatcatcagttttttcatcaaaatctgagaaatcttcatctgaatccaaatccattgtgaattttgtttttgttgctgctctccgtggctctgtttctcgtggagggacatcaaaattactttcgtcactgctcctatctgattctgaatcaggccagggatttctcttctttccttttttgattggcttaaatgccaatgtagtttgtttctttgtctttgtacctggttctcttttctgtttcttttctaatctttgttttaggccttctagttccacaccatcttcttgagggcttccttcagtattttcattcttaattttctttttatttttcttttctgcctctgctttcatttctatggttattcgtggaatgactctttgaccacgcggagaaggcaaaacttcagccatttgtgtttttttccccttggccttcccccctttcccaggaagtccgacttgttcatcttgtttttccttggcttcaacagcctccaattcttcaataaatgtagccaagtcttctttccacaaatctgatggactctttctttttaatgtgtccagctcttgttctttttcatttcttagcctgcagagttcatctttcttttccttggttaaataccaaaggggcatatcaagaagatagttgaaggttggtccagaatctgttacggagtcactcttttcagtttccttttcgttgtcactctcttcattttcttcttcatctggaaccttttgctgggcttctttccaggccttcacaggatccgaatcatatcccctctgaatcagaactttaattaattctttcttaggcttattttcaatgattattttgccatctattttctctaagataaagcgagcctgattattcagtttagcagattcagcaccaagcattcctaggagccattcttttcttaatccataatatttaagtctgagttcaaaaaagtctcttagaatatccaacaccgtgtcatatttctttaaacagcctacgtggtcaaaaagcaccatagagttgcatgtgagactagtttggagtttgaagactttgtgtagtccaactctctctgcctctgccagtttttcttcagtcatcttcacaacaaatttcacagtggtatctgtatggtattccctatagtctgttatgagaggaggtgtcttctcggtgccattcaacatgggttctagaacttgttctttgtatgtctgggtccatgttctgacgggaagctctgagatttcaatggttgtagaattaagaatagctacttcaccactaatcacatattgatttggagccagttcttcaatagtacccttgaagttcttgtaacttggaagcattggcaaaggttcttctccatccatcaaacgcctgatgttatttacaatttcacgcacatcaaagttggggattttgcaggaccacccagtaccgattccttcagcaccatttatcagcaccatgggaataataggaatgtaccattcaggctcaacacgctggttgtcatcatataaaaacttcaacgtgtgatcatcttttggtggaaataacaatcgagccaaagagctgagcattgtaaagatgtatcgtggactagcagaatccttgccaccatgtagcctggtaccaaactgaccaatgggctgcaagaggtttagattattgctacccacaaaattctgagccaaattgataatggtcatcattagtgacatctcaccatgatgataagaagacatttcagccactgatccagctaattgggcaacctttacttctcgcttgtcattccgtttgaagcaagtaaacaaaacctttctctgacctggtttcaaaccatccaccatagaagggatagatctctcgttatcagaatttgagaacaagataagttccttgttgatgaagtcattatatgtcagatatgtggtagtttgtccatacaagtaatcctcaggaagcccaagtaactttcgttgtcttctatcctccatgaaattagttaaccattcctttcgatcatctatctgttttttgctaaaggccaggctgatagcagcatcatcttcaggaccagaatatttgaactggatacgatgtcttttcatatctgcaaagtattctttagcttcctttgatgtgctggtgcccaaacctttgtaatatttgactttccattttttatgatttggagtagaactcttccactcttcaaattcaggaaggctgtaaaatgccatttcttgcttgtttttagatacctttacaatgggagtgataaattcctccagaaaacgatgtcgcagaagagagggccagttgtgatggataaaattaatcagcaagcctttgatgtgggaaccatcttggtcctgatctgtcataatcattatcttcccataacgaagcgtcttcaatgaatcttcatcttcatagtttttcttgtactgaagacccacaatcttgatgatattgttaatctcagcattttccatgatctgcttatgagaagcttctcgaacattgagtatttttcctctaagagggaaaaccccatatttgtctctcccaaccacaccaaggcctgaaacagccaaagttttggctgaatctccctcagtcaggataagcgtacactcagtggagtttcggccccctgcatcattggcatcatcgagtttgggaattcccttgattctattatgttttacagctgaacacttcttgtttaactggacttgggccttaaacttcacccagtttagtatgctttctacaataccacagccaatggcagctttgataaatttttcactcaattggcatgttgatccaaagctcttgggttgtaaagtcatgttttcttttgtctgagagtcaaaggttgggttttcaattaaggcatttacaaaaatccacatgtgatttttcacctgatgtgcttttactgcaacaccacccttgttcttcttcttcacaacatcaacaagtttagtcacaatctgatcagctacataatcaacatgtctgccacccttggatgtagcaatgctgttgacaaagctaatttgctgaaagcctttttcactcatagttaaacacacttcccacctgtggtttacttgttcatgtattactttcaaggagttaccagtttcatccaacttgtccttcaaatacatgtccacataactacgaaatccttttactggcagtttatttccattaagaaagactttcacatctttggtggatccagcaatatcatcggctcttctgaccattagtgcaacaatatctttgtccaggctttgcattttaaacttagacaaatcaggctgaaaggtgatacatgtataatcttctccattgaagggcttgagttccatctcaccagctcttcccatattatccatccatgtctgtttgaacattttcttgtattctctactggctgtttccacagtaaatttggtactgaatatgttacacaatttggctccatagccatttcgaccacctgtcactttcttttcatcatcatcatagttactagaagttaggagctgtccaaatatgagagctgggacatacatcttttcaactttgtgttcaacaacaggaataccttttccattattccatatactaattaaattgttttccggatcaattgtgactctaatacaagacatttttgggtccctttgtttgttgtccgcagcattaactagaatctcatcaaagattttgtacaaaccaggaacaaaagtgacttccctatagttaatgccaacatcttcatcgtaaacccacatttgctgggtcactaattccacagaaccaatgtaggtgtctgggcggagcaaaatatgttccaattgtgttttcttttgatagattctttcaacagacagtcttttcttagcatcttcatttttctttattttgttgacttgcatattttcatttacaggctgcaatggtgacacttccatggtgacggtcgtgaagggatcggtactgggtggtcc

SEQ ID NO: 4235 - DNA, 2388 bp, Homo sapiens
  misc_feature (1)...(2388): n = A,T,C or G
gccaagacagggttttattttttaccccagctgatctcaaacccctgggctcaagtaatcctcccgccccagcctccctaagtgctggganaacaggcatgaaccactgtgcccggccacatttatttatgagattaagtgaccaagctatatgcaccacaaaaacagagaccatatatgtcttttttcacgattgtattttcagaactatcacaggagttaataaatttgaaggatggatggatgatagatggaggaaagtgggtttaatatataaaggtgantaatttttatttcccctttaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaagtaaggaaaactaaagaacattatagataaactgtaagagtggaatggccaatatacttcagggtactttgccccagaaattactgtgtcttaatagagcagtaaattatgttaaagctttgaaacactgaagcatctttcaggagatttaaaaactaaaatattcatgaaatgttatgtcaacctatgaattgtttctcctactaccctctttgatttttttgtatatggtttttttactagcaaaaacaaaattcacaatggatttggattcagatgaagatttctcagattttgatgaaaaaactgatgatgaagattttgtcccatcagatgctagtccacctaagaccaaaacttccccaaagcaagtatcttatctaatatgggttttgtcatcgattgtttctaatatattgttttttgcttgacacatttagaattggttgtccggatttttttttttaaattctagacttagtaacaaagaactgaaaccacagaaaagtgtcgtgtcaggtttgtttttaagtaaaagtggggagacatctgccttactgggacactcagatccaactgggttctaatcctggctacattatccaagtacttcctttgggaaataaaggtgagttcttattaacattatgttgatactgttcactgggtttagtttcacatgtaaataggtactgcattcagtatactaaaagtaatcatagtgcttgccaggtaactttgctaggtgctagagatacaaaaaataaaaactgttcttgctgataaaaaattcagagattagagcaaagttttaagagtatgttttaaatattccagagaagtcacatatttggtgtttaaataggaattcataccagggacaaagcagaaaatggattttcatgtgttgcttaaatgtactattttcctttccatttgaaataatagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtaagcctaaatctttgagatgggttaatgttgcaattacctaactggtttccacgtgtctatttcaatttttttattgccaaaacttactattgatattacagattaaatgttttccaattggaagcaatttcttttcgatctttataatcaaaattagtagtcaaggctgttccaaaacagcaagttatctctattgattgttcagttacagatcaaactccttgttctactcttttccctccttctcactactgcacttgactagtcaaaaaacaaaacaaaagccaggcagagtggctcatgcctgtaatcccagcactttggggaggctaaaacaagaggattgcttgaggccaggagttcaaggctgcagtgagctatatgatcaagccactgcactccagcctgagtgagagagaaagaccctgtctccaaaaataaggnagcccaaatgtttaaaatcagtgagtttctctcagtaccaggcttcatctagttcatttctgtgacaaggataggatttataagcaattgcaatgtttaacgtaaaacgtattcttgaaattgaattaagtttaaggctgggtgcagtggctcatgcctgtaatcccagcactttgggaggccaaggtgggtggatcacctgaggtcaggagttcgagactagcctggccaacatagtgaaccctcatctctactaaaaacacaaaattagccaggtgtggtggaacatgcctgtagtcagctactcgggaggctgaaacaggagaatcacttgaacccaggaggcagaggctacagtgagccgagatcgtgcactgcactccagcctgggcgagataga

SEQ ID NO: 4236 - DNA, 2719 bp, Homo sapiens
  misc_feature (1)...(2719): n = A,T,C or G
gtttttctgttgttcgttctttgtagaaggatattttggacctattagcctattagtaccagggacatcttttcatcctttaatttataggcctttagcaaaaaacagatagatgatcgaaaggaatggttaactaatttcatggaggatagaagacaacgaaagttacttgggcttcctgaggtaaaagttttaaatatatgccacaaaatggattgttagactgaccttttggtattgatactatagcaaattaaacttactgaatagttattttagtaaaaaatttgatatgatagagttgtgcagcagttaaatttgctttatctttaaaacatataaaatatttctgtattattcaatattttttaaagacttaagaattacagaaataatttcttagttctgaaaggtttctgtttgatttttgtgttgagcattgtttagacccggtagactcatgtaatactatttggtccttcaggattacttgtatggacaaactaccacatatctgacatataatgacttcatcaacaaggaacttatcttgttctcaaattctgataacgagagatctatcccttctatggtggatggtgagttccaatttgttagtctgttttcattgtaagatggaaatcaaattccaaaattggttaaattgaggatacttacgtttgctcttatttcattttaaaggtttgaaaccaggtcagagaaaggttttgtttacttgcttcaaacggaatgacaagcgagaagtaaaggttgcccaattagctggatcagtggctgaaatgtcttcttatcatcatggtgaggtaaacacacaatccatgtttccagaaagcattatatcagaaatccctgcagagtcattctcaaaacagatttggtgaaagtataagctcatatattcatagtaaagaacaagttggtaaaacctgtgaaagaataaaactgcttgccctttgatttctgaaagtaatattcctgcagggatattcataagtctgcaaaggtctacattaaaaaatgcttagtatgtttattataactttgtgatgtcaaaatttagacctccactgatttgaaaattgttataataaattgtgacacatgtatgcatggaatcagtgctgtaacttcagtaaaactgtgtgcactgacactgaggaatatccagggtctattctcaggtgaggaaaaaaagagacagaaccataaactanaaatgtctacaaggatatgttccaaattgttcactttagttacccctgagaactggaaagggcaactttcactttttatatgtgtctgaattgtttgactttacaccaatgtttgtgattactttttgcattaattatgtaaaacagttttaaagaactagattgcctacaggttctagaatttaaaatataatggttgtcttgttgctttcaatcaaaatatagtagggatacaataaatttcacccaacgaacatttgttgaatgcctaccatgtaccaggtatacaaaaataaataaaaatatgttccttatccccaagatataataacaatttagccagagggccaatacacacacagctatagaataaagtgatacatgctagaatagaaatgaacacagcattgtaacacaaaggaggaaatatttcattttgctgaggataaggagaagaactatgccttcaaagttgagtgggatttaatagaaattgttggacggcagccctaaacttggagccagaagttgtaggttcaagtactatttctgccatctattaatctgaggaaagtcactaaacaactagacctcacaaaatgttacaggattatagtgaggttaagtcataatgtatttgtattagtaaaagcctcagcttaatgaatctttttttccccacagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcaggtaggtatgctttcactttctagtgacttgccatttccagttttgaaacaatgtgagatttagttcaccaaaaatacaaaaactcagttaatcagaagatactggcatctagtggcagaggccaggggtgaggcttatacaggaaagcccccccataacaattatccagtgcaacatgtcaattatgctaaggttgagaaatcctgatgtagagcttgggactgagtaaaggagactttgattcttcctaaatatcacaattgaaattttactcctttacaagcctatggaaagtatattatgaatggtcaattttcagctgtcatcccagtcaccctttcagtggcattcaaacagttactaattgctccatccttcttgaaactctttatttggcctctatgactgtagactcttctggttctcttctaccttattagctttctctgctgggtccttctcaccttcccaacctctaaatactggcccattccagggctccttcatcagatctctttccaatgcctacactcaattcccaaatgatctcccattcatccgttctatacctttaaatctccagtcttggtctctcccctgaactcccaacttttatgtctgactgccctcttaacatttcccacttggata

SEQ ID NO: 4237 - DNA, 1261 bp, Homo sapiens
tgagactctgtctcaaacaaacaaacgaacaaacaaacaaaaacatatgggagggaaaaaattcaattttgcacttgacaatgattacaaaatcccttattatccttaacatccaggaaaatactcactggcagtttatttccattaagaaagactttgacatctttggtggatccagcaatatcatatgctcttctgaccattagtgcaacaatatctttgtccaggctttgcattttaaacttagacaaatcaggctgaaaggtgatacatgtataatcttctccattgaagggcttgagttccatctcaccagctcttcccatattatccatccatgtctatggaagtaaagaataggaaacatgaaaaattcaagtcatctcacaaactggaagtaaataacataaatttatgagtcctaataacctaatatatatgcttataattttccatacttcaataacttataaattatgttaaattaaaccaatcattaatgccattataaatggctatactactaccatttatcattaaggtacaagacacttatttacttgcctgtttgaacattttcttgtattctctactggctgtttgcacagtaaatttggtactgaatatgttacacaatttggctccatagccatttcgaccacctggcaaataaatatgaaacactattttattgttactatctcattgacagctttatttcttaatcactggcagagctattcaattatagagatttatttccatatctttaaccctcatgccacagacagtcatttaaatatatatatttttagcaacaaatatgttatttcccctcaatactctacctgtcactttcttttcatcatcatgatagttactagaagttaggagctgtccaaatatgagagctgggacatacatcttttcaactttgtgttcaacaacaggaataccttttccattattccatatactaattaaattgttttccctaagaaaaaaagattgaaaattgtattttacaacacattaaacgaatgcttaacactgatgaatcccctaatgattttggtaaaaatcattaagttaaggtggatacacatcttgtcatatgatcaatggtttcgcaaaaatcaataatcagacaacaagatgtgcgaactcgatatttacacgactctcttaccaattctgcccgaattacacttaaacgactcaacagcttaacgtggcttgcacgcattacttgagtgtaaac

SEQ ID NO: 4238 - DNA, 1425 bp, Homo sapiens
  misc_feature (1)...(1425): n = A,T,C or G
tagaccggattagagaggaggggaaataaaggaaggctcccagctttcttgtttatacaacctagaggttggttggggctttttactaagataggaagttgtttttttgttggagagtggggggctgcttgtatgggcaaatcagtgagtatggaggtaacaaattcaattttggatgtgttgactgaaagcaagtcttaggcatttaagtgagggtgtttgttaaacagctagattaattcaaaagtgatctaagcttaatggtaaaatgtaattgggaaatactgaaatatagacggtcattaagtctttggtaaatcagttaaagtaaagcccttttttacttccttttcagattgggaagacttggagaagctcactatgagaagaatcattgtttctgcagagctaagaagtgcaatggaaaataaagtcaggtgtttctatttttattttcctctaagtactcacagctttgataaatttttcactcaattggcatgttgatccaaagctcttgggttgtaaagtcatgttttcttttgtctgagagtcaaaggttgggttttcaattaaggcatttacaaaaatccacatgtgatttttcacctgcaatagaagttgatattaagccactaaaaaatgtactcatgctttatttatagcctttctcttcttcctggactttagaaaaagaaaactgccaaaagcacatacctgatgtgcttttactgcaacaccacccttgttcttcttcttcacaacatcaacaagtttagtcacaatctgatcagctacataatcaacatgtctgccaccctaataaggaaaaataccaaactgtaaaactcagtatcctcaaaattataataatcaaacattaaaaactaatttaacctcctttatactaagctagcccaatattcaagtccactttatatattaaaaacaataagaacacatatatgtaaagataaatcatgattaataatttaagaataaaattaccttggatgtagcaatgctgttgacaaagctaatttgctgaaagcctttttcactcatagttaaacacacttcccacctgtggtttacttgttcatgtattactttcaaggagttaccagtttcatccaacttgtccttcaaatacatgtccacataactacgaaatccttttacctgtacaggaattaaaaggtaacagtattaagaaagttattaaaaaataggttcaatgatagactatgaggactttccaaaaccaatgcaatgatgttcactgataggcataagggaatggtcattaaaggacacaggccgaggtgggtggatcacttgagcccaggagttcaagaccagcctgggcaacatagtgagatccccacctctattaaaaagaaaaaaaaaaantacccgggcatg

SEQ ID NO: 4239 - DNA, 2795 bp, Homo sapiens
acaggtgcccaccaccacgccagataattttagtatttttagtagagccggggtttcgccatgttggccaggccggtctcaaactcctgacctcaggtgttctgcccaccttggcctcataaagtgctgggattataggcgtgagccaccgtgcctggtctaatttgttttaaccactatatctccaacaagtagctcagtgctagcacaatataattatatagtaaatatttattgaacgaatgaaccaaaaggagcagctccctcagtggtgataacctgacatgggaagatgtgccaccctctatccagaaattattgttctacatctttttaatttttgaatcatttttatttgtattaaggctcatttgtattctagatttctgatagatcccttcttccctaatatgatccctaatatgatcttctcgttttcaggccattggctgtggtattgtagaaagcatactaaactgggtgaagtttaaggcccaagtccagttaaacaagaagtgttcagctgtaaaacataatagaatcaagggaattcccaaactcgatgatgccaatgatgcaggtatatatttaataatgtttccaaacttttaagtcttatagttgttattttattcattaatggcataccacggatatttatttttcccttgacagaataactatattcaacagaataacttgttaaaaatcggcccgtttcctattatggaagatttaggtcatttccatgttataaataatattgaggtgattattttggagtataaaacaagaatgtttatattatgatctattacctaacaaataattttgctcattatatagtaaattgtgttttatcacaaggctataaacagcatgttcaagttagtatatttgaggttgaactaaatgtgctaatattaatatgtatatttttattttagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcaggtagaatataagacgatcttcagaatctaaatctaatttataatacaagactttatgcttatatttaattccctcattaggcattttaaaatatattttagacaatttgtgcttattttgagaaattaggtacattgtagcctattttaacagacctttctgatgtagtaaattataagctaatagctcaaaatactggagctcaagaaaatccaagcaacatatactgttaaatttctttgttcttttcaaatttataaacgatgctttttttggtatatgtccatttcagatcatggaaaatgctgagattaacaatatcatcaagattgtgggtcttcagtacaagaaaaactatgaagatgaagattcattgaagacgcttcgttatgggaagataatgattatgacagatcaggtcagattgttattaaatttttagattgttcaactaaattaagcatgtcttaatttaatttcattgttttttgccatgaaaataaattacttaaataggagctttattcatcatctctaatcaacatctaatcagatatgcttatatcatatgtatgttgcaaatacaggttaagtgagtctggatttgaacagaccttttttgattcccatagaaaatttgacaaattgccagtaggtcagtcataatatttttttatttctaaacaattctttgtttgtttgagatggagtttcgcccttgtcgcccaggctggagtgcaatggtgcaatcttggctcactgcaacctccgcctcatgggttcaagcgattctcctgcctcagcctcccgagtagctgggattgcaggcggatgccaccacacccaactaatttttgtatttttagtggagacagggtttcaccatgttggccaggctggtctcgaacgcctgacctcaggcgatccgcctgcctcggcctcccaaagttctgggattacagatgttagctaccacgcccagcctaacagttcttttgaactttggctttcaaatctttctaggaccaagatggttcccacatcaaaggcttgctgattaattttatccatcacaactggccctctcttctgcgacatcgttttctggaggaatttatcactcccattgtaaaggtacgctaatttctaaggtaccatcatggatattttaagaccctactcctcaaacctggatatacatataagccccgtcacatgtagtggtatacaggggaccccacagtgtacaaagccacagtcattgttttttatcacaggtatctaaaaacaagcaagaaatggcattttacagccttcctgaatttgaagagtggaagagttctactccaaatcataaaaaatggaaagtcaaatattacaaaggtttgtaatgaaacccatatagaacttctcattttattatacaccctgtacaagactatatgaaggaacttggtatttttggttttataggtttgggcaccagcacatcaaaggaagctaaagaatactttgcagatatgaaaagacatcgtatccagttcaaatattctggtcctgaagatgatgctgctatcagcctggtaggtttgagttgtattttatatacattctaattttagaaatcactactttagccagttgaaaacatttacatttttgtataagactccgtatcaaaaaaaaaaaa

SEQ ID NO: 4240 - DNA, 1520 bp, Homo sapiens
  misc_feature (1)...(1520): n = A,T,C or G
gtccatgtgcgngacacatagcaagtgctcaataaatattgntaaatgtatattagtcagcaagtaaaaccaagataattttcatgnataatacatgtcctttccataaaagtnaagtgtgaaattcagtatttttgtaaaataacattctttgtttcttttctttagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatggtaagtattctgtgtgtgttaagagccttaactttnccttgggtttcagttgaatagattgtatgattaaagatgatgcaaacataaaatttaatttcatactttagatttattgttaaacgctgttgtgatttccgtctagtatcacatttagaaaacatactgtttttttaaatgccaatttagcttccaagttacaagaacttcaagggtactattgaagaactggctccaaatcaatatgtgattagtggtgaagtagctattcttaattctacaaccattgaaatctcagagcttcccgtcagaacatggacccaggtaaaataattgtggattcttttttaggtttgtgatccaaagaaatacccttttgtactattgctgtggactattcagaagcctatattttagaaacttcaggattatttctttctttagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtatgtatttgttttgtgagatgtacacgtttcaatttatattaaagattaatatcaattttaaaagtatatcttagtctacctttataaagtttagccaatttgtctattcttggctctaatcttgttttcctttttcaggtgctttttgaccacgtaggctgtttaaagaaatatgacacggtgttggatattctaagagaccttttttgaactcagacttaaatattatggattaagaaaagaatggctcctaggaatgcttggtgctgaatctgctaaactgaataatcaggctcgctttatcttagagaaaatagatggcaaaataatcattggtatgttttgggaataataactgcttactaaaactctagttacgccaaactttctttaaacattttggtgagagtaatggtggagaaagaaggcaaaatccatttaattcacctggtcacttatacacgcattcttaaaa

SEQ ID NO: 4241 - DNA, 2163 bp, Homo sapiens
  misc_feature (1)...(2163): n = A,T,C or G
cctggggaggccacagttaaatgaaacccaagggcaggccatggggtgccccaggctccaacctcccctgnttccaagttacaagaaacttcaagggttactatgaagaactggcctccaaatcaatatgttgattagatggtgaagtagctattcttaattctacaaccattgaaatctcagagcttcccgtcagaacatggacccagacatacaaagaacaagttctagacccatgttgaatggcaccgagaagacacctcctctcataacagactatagggaatacatacagataccactgtgaaatttgttgtgaagatgactgacgaaaaactggcagaggcagaggagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagccctcaagaagatggcggaactagaaggcctaaaacaaagattagaaaagaaacagaaaagagaaccaggtacaaagacaaagaaacaaactacattggcatttaagccaatcaaaaaaa

SEQ ID NO: 4242 - DNA, 1345 bp, Homo sapiens
taatacaatctgacctgatctgtcataatcattatcttcccataacgaagcgtcttcaatgaatcttcatcttcatagtttttcttgtactgaagacccacaatcttgatgatattgttaatctcagcattttccatgatctgaaatggacatataccaaaaaaagcatcgtttataaatttgaaaagaacaaagaaatttaacagtatatgttgcttggattttcttgagctccagtattttgagctattagcttataatttactacatcagaaaggtctgttaaaataggctacaatgtaccttatttctcaaaataagcacaaattgtctaaaatatattttaaaatgccattagtgggaattaaatataagcataaagtcttgtattataaattagatttagattctgaagatcgtcttatattctacctgcttatgagaagcttctcgaacattgagtatttttcctctaagagggaaaaccccatatttgtctctcccaaccacaccaaggcctgaaacagccaaagttttggctgaatctccctcagtcaggataagcgtacactcagtggagtttcggccccctaaataaaaatatacatattaatattagcacattagttcaacctcaaatatactaacttgaacatgctgtttatagccttgtgataaaacacaatttactatataatgagcaaaattatttgttaggtaatagatcataatataaacattcttgttttatactccaaaataatcacctcaatattatttataacatggaaatgacctaaatcttccataataggaaacgggccgatttttaacaagttattctgttgaatatagttattctgtgcaaggaaaaataaatatccgtggtatgccattaatgaataaaataacaactataagacttaaaagtttggaaacattattaaatatatacctgcatcattggcatcatcgagtttgggaattcccttgattctattatgttttacagctgaacacttcttgtttaactggacttgggccttaaacttcacccagtttagtatgctttctacaataccacagccaatggcctgaaaaccagaagattcatattagggatcatattagggaagaagggatctatcagaaatctagaatacaaatgagccttaatacaaataaaaatgattcaaaaattaaaaagatgtagaacaataatttctggatagagggtggcacatcttcccatgtcaggttatcaccactgagggagctgctcctttggttcattcgttcaataaatatttactatataattatattgtgctagcactgagctact

SEQ ID NO: 4243 - DNA, 952 bp, Homo sapiens
tcctaaaaaattactcaaaatcattatctctgtttacttttttaaaaatagaaaataagcctaagaaagaattaattaaagttctgattcagaggggatatgattcggatcctgtgaaggcctggaaagaagcccagcaaaaggtaatcttgggtggcacttttctatattgttaaagactatgtattgtacaatgtttatgtttcacattttctaataaagctagattttaattaatcctttaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagtgagttgatagtaggatggtacatgctgcttagttttgttctattctaatggtaaaagtaaaattgtgtgttgcatgaaaatgctgcttgtatacatatattaactcaattttgtaattatcttatgaaggaacaagagctggacacattaaaaagaaagagtccatcagatttgtggaaagaagacttggctacatttattgaagaattggaggtatgtagtttataatgcccatgttagaatttttattaatgaaataatatattccagcagtatacctttgtcaagataattcacaattgggcaataaaaagaaaataagaggcataaggataaattccaaatagcgtataaaagaacagattattgggccaggtgcagtggctcacgctggtatcccagcattttggaaggctgaattgggtggatcacttgaggtcaggggttcaagaccagcctggccaacatggtaaaaccccatttctactaaaaacacaaaaattagccacgcatgatggtgccataccagttactcaggag

SEQ ID NO: 4244 - DNA, 815 bp, Homo sapiens
tttttttttttttttttttttttttttttttttttttttttctctttttaagcccaggctttattccagcctctttttgaggaatttgactgaaaagttccctccctctcggctgatgcgccgtcccatcctgggctcctagtgtagggctcctacccttggctccagcaatgctgatgatgaggtgctggggtccccgaggacaggaggcctccaggaaggaaccggcctcagtccacgccgtccagggactgtggctctgccctctcgagctgtagcacctgattttctatgcaccgaaactgccaaggccagcttgtgttgtacagaaatggtcgcagatcaaacctgttgtcctcagggctgtagttctcggcgtggtacgcgggtgtgagcgtggtcatcttgtgtctgttcatggagtacttggagaaaaaccgcttcactttgtcagcgacctgtctcggggtgcagatgtgtctccacatgccgaggagtttgcagaacatgctgtagggccccatcttggccaccttcctgagtttcccatagaccgagagctccgcatatgtcatccccatatcttcctcgtcggtctgggacacctgtccatcagccaagggctccagctctgcggtggcgggcgccaacaggatgctctgcagggcaggaagctggaagcgctggatgcagaacctggacgaaggccctgagggtccgtcttgctgatcccgccttattggggttatgtcccgactggagccacccgacctggccaggtacccccggagaccctcatccagtttgcggatccc

SEQ ID NO: 4245 - DNA, 693 bp, Homo sapiens
  misc_feature (1)...(693): n = A,T,C or G
acaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtgggtggttttgaaaccgggtcagagaaggttttgtttanttgctttcaaacgggattgacagcgagagtaaggttgcccatttggtttt

SEQ ID NO: 4246 - DNA, 573 bp, Homo sapiens
aagaattaattaaagttctgattcagaggggatatgattcggatcctgtgaaggcctggaaagaagcccagcaaaaggtaatccttggtgcacttttctatattgttaaagactatgtattgtacaaatgtttatgtttcacattttctaataaagctagattttaattaatcctttaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagtgagttgatagtaggatggtacatgctgcttagttttgttctattctaatggtaaaagtaaaattgtgtgttgcatgaaaatctgcttgattacatatattaactcaattttgatattatcttatgaaggaacaagagctggacacattaaaaagaaagagtccatcagatttgtggaaagaagacttggctacatttattgaagaattggaggtatgtagtttataa

SEQ ID NO: 4247 - DNA, 596 bp, Homo sapiens
  misc_feature (1)...(596): n = A,T,C or G
ctctttttaagcccaggctttattccagcctctttttgaggaatttgactgaaaagttccctccctctcggctgatgcgccgtcccatcctgggctcctagtgtagggctcctacccttggctccagcaatgctgatgatgaggtgctggggtccccgaggacaggaggcctccaggaaggaaccggcctcagtccacgccgtccagggactgtggctctgccctctcgagctgtagcacctgattttctatgcaccgaaactgccaaggccagcttgtgttgtacagaaatggtcgcagatcaaacctgttgtcctcagggctgtagttctcggcgtggtacgcgggtgtgagcgtggtcatcttgtgtctgttcatggagtacttggagaaaaaccgcttcactttgtcagcgacctgtctcggggtgcagatgtgtctccacatgccgagggctccagctctgcggtggccggcgccaacaggatgctctgcagggcaggaagctggaagcgctggatgcagaactggacgaangcccctgaggtccgtcttgctgtcccngcctatgggggtgatgtcgcacttgagcagtc

SEQ ID NO: 4248 - DNA, 549 bp, Homo sapiens
tttttttttttttgtgagcaacaaggctgtttatttcacctgggtgcaggcgggctgagtctgaaaagagtcagcgaaaggagataggggtggggccgttttataagatttgggtaggtaaaggaaaattacagtcaaaggggggttgttctctggcagacaggagtggaggtcacaaggtgctcagtaggggagcttttgagccaggatgagccaggagaaggaatttcacaagatagtgtcatcagttaaggcaggaacaggccattttcacttcttttgtggtggaatgtcatcagttaaggcaggaaccggccatctggatgtgtacgtgcaggttacaggggacatgatggcttagcttgggctcagaggcccttggctccagcaatgctgatgatgaggtgctggggtccccgaggacaggaggcctccaggaaggaaccggcctcagtccacgccgtccaaggactgtggctctgcctctcgagctgtagcacctgattttctatgcaccgaaactgccaaggccagcttgtgcctcgtgcc

SEQ ID NO: 4249 - DNA, 497 bp, Homo sapiens
atgatggaccattatcaattggctcagaatttgtgggtagcaataatctaaacctcttgcagcccattggtcagtctggtacagggctacatggtggcaaggattctgctagtccacgatacatctttacaatgctcagctctttggcccgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaggaacctttgccaatgcttccaagttacaagaacttcaagggtactattgaagaactggctccaaatcaatatgtgattagtggtgaagtagctattcttaattctacaaccattgaaatctcagagcttcccgtctctaca

SEQ ID NO: 4250 - DNA, 576 bp, Homo sapiens
  misc_feature (1)...(576): n = A,T,C or G
ccacccgttcaaaacatctgggtcaggagcagccaaagctcaanttccatccaagcntaagaaatctcaggtatcctgctggtgntccctgagaaggtgtgggtgccgccaccccagtgcactcagacctatccgggcagggggcatccacgatgtgacgtgggtaacagactccttggctccagcaatgctgatgatgaggtgctggggtccccgaggacaggaggcctccaggaaggaaccggcctcagtccacgccgtccagggactgtgctctgccctctcgagctgtagcacctgattttctatgcaccgaaactncaaggccagcttgtgttgtacagaaatggtcgcagatcaaacctgttgtcctcagggctgtagttctcggcgtggtacgcgggtgtgagcgtggtcatcttgtgtctgttcatggagtacttggagaaaaaccgcttcactttgtcagcgacctgtctcggggtgcagatgtgtctccacatgccgaggagtttgcagaacatgctgtagggccccatcttggccaccttcctgagtttcccatagaccgaagac

SEQ ID NO: 4251 - DNA, 473 bp, Homo sapiens
ttttcaatatatagaatttttatttgtcaacacgaaaaaagtaaatttaaaaaacgctttaaacatacttgtccctttgcagaaaggaggacagtaaaaaagttactgtgtatataagaaagtttttcaatccttcatggaaataacctcacgtttcttctacagacatgaaacatggagagagaaacatttctgctggatttacctgattttctatgcaccgaaactgccaaggccagcttgtgttgtacagaaatggtcgcagatcaaacctgttgtcctcagggctgtagttctcggcgtggtacgcgggtgtgagcgtggtcatcttgtgtctgttcatggagtacttggagaaaaaccgcttcactttgtcagcgacctggtgggcgtgcaacacacgagcttcatgttaccaaaactggagagaccccaggccggaattcccatgctggatcatacaagcaaatgac

SEQ ID NO: 4252 - DNA, 540 bp, Homo sapiens
  misc_feature (1)...(540): n = A,T,C or G
aactctagttacgccaaactttctttaaacatttttggtgagagtaatggtggagaaagaggcaaaatccatttaattcacctggtcacttatacacgcatttctttaaaatatctgattaggtatttatagtttgaaagagatgatgtttccttgactgagcatcttgagaaatcaagatttagttgacaattagacatgaggagaatagagagctagaagaccttgcataaactgattgaccaagagaatagatacactaatcatgtctacaggaacagaaaataaaagagacagagaagagataataaatctgatggtaaaaaaaaaaaaaggcaggaagattacgaatggcttctactctctgggtgtggtggcgcatgctgttaatctccagcacttgagctgggggaggtccaaggctggcagtggagcctagggtagttgccactgccttcccaggcctggggaccacaaggagttgaggaggaggaccctgttttccccaaaaaaattggttttggttccntaggcctcctt

SEQ ID NO: 4253 - DNA, 540 bp, Homo sapiens
tgtatatacatgttttatttttagtttctccctggttttcctcaaaaaggttaagtggtagaatcaggaataaaacccagtccttctgtctccacaccttccttttcaaggtgtgttttaattacatcttcactattgttgatagtatactaggttatggagcaatttatcactagtttttaagatgtaacaaaatgaaatcagtttaactgttgggtgtttagatattgtaatgtttttgttaacatttaaacttgctttcttatatcccttctgtaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaaggtaatactcttgtggtggctcacacctatctatcccaacactttgggggccaaggtgggtggatcacttgaggtcagt

SEQ ID NO: 4254 - DNA, 536 bp, Homo sapiens
tttatttttcttttctgcctctgctttcatttctatggttattcgtggaatgactctttgaccacgcggagaaggcaaaacttcagccatttgtgtttttttccccttggccttcccccctttcccaggaagtccgacttgttcatcttgtttttccttggcttcaacagcctccaattcttcaataaatgtagccaagtcttctttccacaaatctgatggactctttctttttaatgtgtccagctcttgttctttttcatttcttagcctgcagagttcatctttcttttccttggttaaataccaaaggggcatatcaagaagatatgtggtagtttgtccatacaagtaatcctcaggaagcccaagtaactttcgttgtcttctatcctccatgaaattagttaaccattcctttcgatcatctatctgttttttgctaaaggccaagctgatagcagcatcatcttcaggaccagaatatttgaaccgggaaacgaagtcttttacaaaccgcagaggattctttgacg

SEQ ID NO: 4255 - DNA, 470 bp, Homo sapiens
agatttgtggaaagaagacttggctacatttattgaagaattggaggctgttgaagccaaggaaaaacaagatgaacaagtcggacttcctgggaaagtggggaaggccaaggggaaaaaaacacaaatggctgaagttttgccttctccgcgtggtcaaagagtcattccacgaataaccatagaaatgaaagcagaggcagaaaagaaaaatataaagaagattaagaatgaaaatactggaggaatccctcaagaagatggtgttggactatgaggccttaaaccaaggtttggaaaggaaccggaaaggggacccagttccaaggccaaggaaccaacttccatgggaatttaggccattcaaaaagggaatgaggggaattccctgtcctgattcggattcgttaggggcagtgccgaagtaatttggggtccttcccgggaacgggccccgagaccgcaccaaa

SEQ ID NO: 4256 - DNA, 424 bp, Homo sapiens
gtcgacgcccaggatgggacggcgcatcagcggtgagggagggaacttttcagtcaaattcctcaaaaagaggctggaataaagcctgggctcctagtgtagggctcctacccttggctccagcaatgctgatgatgaggtgctggggtccccgaggacaggaggcctccaggaaggaaccggcctcagtccacgccgtccagggactgtggctctgcctctcgagctgtagcacctgattttctatgcaccgaaactgccaaggccagcttgtgttgtacagaaatggtcgcagatcaaacctgttgtcctcagggctgtagttctcggcgtggtacgcgggtgtgagcgtggtcatcttgtgtctgttcatggagtacttggagaaaaaccgcttcactttgtcagcgaactgtctcggggt

SEQ ID NO: 4257 - DNA, 426 bp, Homo sapiens
aagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagtttaacctgggaagctccttt

SEQ ID NO: 4258 - DNA, 422 bp, Homo sapiens
  misc_feature (1)...(422): n = A,T,C or G
aagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttttgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaaagtacctgggaaggagtcagatgaaggtngatcttgtttttaaaatgtngagggcgattatttttaaagttaatttattcttaaccaaggccccaa

SEQ ID NO: 4259 - DNA, 525 bp, Homo sapiens
gtgttcttgtagttgaaatacaacgatggtttttcatatcattggtcgtggttgtagtccgtgcgagaataatgatgtatgctttgtttctgttgagtgtgggtttagtaatggggtttgtggggttttcttctaagccttctcctatttatgggggtttagtactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgaccgctgtataccgttggcatgctagctttatc

SEQ ID NO: 4260 - DNA, 336 bp, Homo sapiens
cattactcaagtcacacacatataacaatgtagacaggtcttaacaaagtttacaaattcgaaattatcggagatttcccaaaatgaatctaatagctcattgctgagcatggttatcaatataacatttaagatcttggatcaaatgttgtccccgagtcttctgcaatccagtcctcttagaaattggtttctctctttgggagattcagactcagaggcagccagaggggacaggtcaagagattttaaaacagatcatcttcatctgactcttccaggtactttataggtttctttgcccgtacagatgttgcccgaggagccacagctgag

SEQ ID NO: 4261 - DNA, 438 bp, Homo sapiens
tgcaatgtttagaacattttattaaagtacaaaattgttggaatttagctaatagaaaaacatagtaaatatttacaaaaacgttgataacattactcaagtcacacacatataacaatgtagacaggtcttaacaaagtttacaaattgaaattatggagatttcccaaaatgaatctaatagctcattgctgagcatggttatcaatataacatttaacgatcttgcatcaaatggttgtccccagtcttcttcactgtcacaattcttttaggaactggaattgtaattccagttcatctgggaaatgtgtaacaggaaggcttgaagacagtggtacactggccttacatcatcagcttcaaaggctgcacgacacttttttgggttcaggtctttgtactaaatttggggaaattttggctttaggggactgc

SEQ ID NO: 4262 - DNA, 312 bp, Homo sapiens
tacaaaaacgttgataacattactcaagtcacacacatataacaatgtagacaggtcttaacaaagtttacaaattgaaattatggagatttcccaaaatgaatctaatagctcattgctgagcatggttatcaatataacatttaagatcttggatcaaatattaaaaaagagtgttctgcaaccccccccccccccacccccccctctccccccccccccccccacactcagaggaagacagaggggacaggtcaagacgctgaatcatcacataactactctaattttcttcattctattgactgtgtc

SEQ ID NO: 4263 - DNA, 284 bp, Homo sapiens
  misc_feature (1)...(284): n = A,T,C or G
cttttaacccagcttnnccagctctttttagaattgactaaaagtccctcccccncgctgatcgcgtccatcctgggctcctagtgtagggctcctacccttggctccagcaatgctgatgatgaggtgctggggtccccgaggacaggagcctccaggaaggaaccggcctcagtccacgccgtccagggactgtgctatatgcacagtatgtagaaactattaatcagatatgtaatctttccatttataactctgatgtgtacacataatggtcgcagatc

SEQ ID NO: 4264 - DNA, 239 bp, Homo sapiens
  misc_feature (1)...(239): n = A,T,C or G
gtgaacatatttcctttataggggcagggcactgangnancccctaatnattnnnatcaaaatcattaagttaaggtagatacacatctngtcatatgancaaatggtttcgccaaaaatcaataatcagacaacaaaatgtgcgaactcgatattttacacgantctctttaccaattctgccccgaattacacttaaaacgactcancagcttaacgttggcttgccacgccttact

SEQ ID NO: 4265 - DNA, 203 bp, Homo sapiens
taaagtacaaaattgttggaatttagctaatagaaaaacatagtaaatatttacaaaaacgttgataacattactcaagtcacacacctatagacaatgtacgacagggcttctgtgcgctgaccactcgagctgtagcacctgattttctatgcaccgaaactgccaaggccagcttgtgttgtacagaatggtctcagatc

SEQ ID NO: 4266 - DNA, 503 bp, Homo sapiens
tttttttttttttttttaccatgaacctaattttttaatgggctcaacagggtatgtaacattgcaaaattattatgatgatgacatttcacctcggtataaaaagaaatgtctgttgaaaataaaccccttttcagaaagaaagaaagagagagaggcagggagggaaggagggaggaaggaaggaagaaggaaggaaggaaggaaggaaggaaggaaggaaggaaggaaggaaggaaggaaggaaggaaggaacttcttgcccagaccaatgtcatggcaattttcccctatgtttttttctatttggtttacacttctttcacctttttatgaccggtgctttgcccagtacctggcacatcaggactcaataaacacttgctgaatgagcaaattctatggttttaaattgtagtttaacataataagtgacatatcctggaagccaccgttctcatgtgaaggaacaaagacttcaagaaaatgggctttaccagact

SEQ ID NO: 4267 - DNA, 1050 bp, Homo sapiens
tcatggagaggttatagctcctgacttctctgacttcttgctcttggacaaagcagctgcctgcttcaggagctctcggtttttggcctgcagttgttctgtgacttctttgtgggttttctccatctggttcattttggctctcatctgcgattcctggtactgaaaatcagccttcaactctgtaatcttcttctctttctctaaaatcatttgatccttttgatgcaacatcttcttcagggtagccacttcttccttcagttgggcaatgatgacaaagtggtcagtgcctggtgagtccagagccaggtctggggagaagctgtctccattagttgtgattgactcaaacttggactttttctttgggatttcattttgaattgaagatgtagaaagtgttttctggctgttataatggccaccaccactcaggcgactatactgctccttctcctggtggccagcacgagaagagctactcaggtgtttcctctgctctttggtcttctgaaggacccgtttgtatgaaagtgtgcacagccagcacagcaatttcccatctaccttctttctatcatctttcctgtcaaatgcacactgctgcttgcactgttcacaagaatagggtggtccatacttcttttctgaatttgtgcagcgctggcatttattcccaataaatgctgcaattatgttgcaatactgacaaggtttgggcgttccatacaactgcacgttctgagcacatttcttgcatattgtattggttttaatgcctgtaatcccagctactcgggaggatgaggcaggagaatcgcttgaacctgggaggtggaggttgcagtgagccgagatcgtgccattgcactctagcctctcctgctggtactcagtcctgcagtaggtgcacttcacaacagggtgtgcaatccgacattccttgcacagctgctgcccctgagacagcgcctcgaaggggaagcgctggtggcacttggtgcaggcgtagagcgccgccatgtccggcccgggccgcgctcaccg

SEQ ID NO: 4268 - DNA, 963 bp, Homo sapiens
tcatggagaggttatagctcctgacttctctgacttcttgctcttggacaaagcagctgcctgcttcaggagctctcggtttttggcctgcagttgttctgtgacttctttgtgggttttctccatctggttcattttggctctcatctgcgattcctggtactgaaaatcagccttcaactctgtaatcttcttctctttctctaaaatcatttgatccttttgatgcaacatcttcttcagggtagccacttcttccttcagttgggcaatgatgacaaagtggtcagtgcctggtgagtccagagccaggtctggggagaagctgttataatggccaccaccactcaggcgactatactgctccttctcctggtggccagcacgagaagagctactcaggtgtttcctctgctctttggtcttctgaaggacccgtttgtatgaaagtgtgcacagccagcacagcaatttcccatctaccttctttctatcatctttcctgtcaaatgcacactgctgcttgcactgttcacaagaatagggtggtccatacttcttttctgaatttgtgcagcgctggcatttattcccaataaatgctgcaattatgttgcaatactgacaaggtttgggcgttccatacaactgcacgttctgagcacatttcttgcatattgtattggttttaatgcctgtaatcccagctactcgggaggatgaggcaggagaatcgcttgaacctgggaggtggaggttgcagtgagccgagatcgtgccattgcactctagcctctcctgctggtactcagtcctgcagtaggtgcacttcacaacagggtgtgcaatccgacattccttgcacagctgctgcccctgagacagcgcctcgaaggggaagcgctggtggcacttggtgcaggcgtagagcgccgccatgtccggcccgggccgcgctcaccg

SEQ ID NO: 4269 - DNA, 527 bp, Homo sapiens
tctcctggtggccagcacgagaagagctactcaggtgtttcctctgctctttggtcttctgaaggacccgtttgtatgaaagtgtgcacagccagcacagcaatttcccatctaccttctttctatcatctttcctgtcaaatgcacactgctgcttgcactgttcacaagaatagggtggtccatacttcttttctgaatttgtgcagcgctggcatttattcccaataaatgctgcaattatgttgcaatactgacaaggtttgggcgttccatacaactgcacgttctgagcacatttcttgcatattgtattggttttactctcctgctggtactcagtcctgcagtaggtgcacttcacaacagggtgtgcaatccgacattccttgcacagctgctgcccctgagacagcgcctcgaaggggaagcgctggtggcacttggtgcaggcgtagagcgccgccatgtccggcccgggccgcgctcaccgacccgccggcccggcccgccgatttatctgacag

SEQ ID NO: 4270 - DNA, 516 bp, Homo sapiens
tttttttttttttggaatcacatctggtttattcaaaaatcaaagaacatacttaataattctactgttttggaggggaaaagatcagaacacatccaagagtgaaacaatacaaagtatctacaggctgggcatggtggctcacgcctgtaatcctagcactttgtgaggttgaggtgggaggattgcttgaagccaggagttcaagactagcccaggcaatatagcgagagcccatctctgcagttgttctgtgacttctttgtgggttttctccatctggttcattttggctctcatctgcgattcctggtactgaaaatcagccttcaactctgtaatcttcttctctttctctaaaatcatttgatccttttgatgcaacatcttcttcagggtagccacttcttccttcagttgggcaatgatgacaaagtggtcagtgcctggtgagtccagagccaggtctggggagaagctgttataatggccaccaccactcaggcgactatactg

SEQ ID NO: 4271 - DNA, 848 bp, Homo sapiens
  misc_feature (1)...(848): n = A,T,C or G
naanacgtacantgacccctatccttttaggcctgcgaataattccatcctgaaaactgccacactttctttatccagcctatcattcatgggcattcgagttggttccaagtctttgctattgtaaatagtgctgcagtaaacatacgtgtccacgtgtcttcctagtaggaacttcttcctcttcagcccgctgagtagctggcactttaaggcaggtgccaacgcaccggcagcaagcttccttttttgcccgggaaaaactgaggtgcaggtagtataagccattgatcacggaacgcacaggagcagagctcgagtccaagcatcgtggctccacccgtcatgctggatgcatctttaggctccgctctaggtatgtgtatcctttacgggatcagccaccggaagttgccttgcgagcacgatgacaaacctctgccggctcttttgggtctcatccctgtatctatacgttgcatcccaacataaagaccggaatgttcctttcgctgacccagtctctcaccctttccaaactccagaaatcttgtctgtcctcggaagaactccccctgcttctttctctaaaggctgtcttcaggccgggcacagtggggaggatcgcttgagcccagaaggccgcagtgagggtgaggatcgcggccattggcacttgcaggcccccggcggcaggagcggcaggcccccgtctttcgaaaacaaaacaaaacaaaaaccaaccaaccaaccaacaaacaaacacagacaaagaaagaaagagcccaggcaacctagtgaaaacctgttcgggctggggcgtacctgtaccccagctgttccggagc

SEQ ID NO: 4272 - DNA, 356 bp, Homo sapiens
tttaactcttaatcacagtgaatttattattatctcctatgttacataaggaaatgaagttggaaagaccacatggcattttttttaaacattgaaaccctacttgagatcaagcccaaacttgaacctatgttgtctgactatagaacttctgttatttatcagtatgttttattatttttatatattaaaattgaagatcttggagtttaaaaatttttttagtactaccgattgtaagacccctttttatgatactttgtctttatgtaaacctaaactatacttttaatatatatatatatatatatatatatatatatatatatatatatatatatatatatatatacaga

SEQ ID NO: 4273 - DNA, 406 bp, Homo sapiens
ggtcgactttttttttttttttgtaagtaacctgttgtttctctccagctgcttttaaaattttcttttgatctttgatgttttgcagtttctccaaagtgggcctgtgtgtgtgtgtgtgtgtgtgtgtgtgtgtgtgtgtgtgtgtgtgtgtatgtttcttgcttggaattttgtgttatttttcaatcttaagtctcaggtttgtcttcaattctagaaaaattctcatctattctctcatccactattgtctttccccaatttttttctagccttatcttccagaattcctctcagacataggtggccctggttgcttgatcctgtctctaagttggtctttcatgttttctctcctcagattgtgagatttcctcatatttatactctggttgactatttc

SEQ ID NO: 4274 - DNA, 534 bp, Homo sapiens
gcccccagtgtactcccactttccccaccaggaccataaggcagagcaacagggttgccctggggctcctccgctgttcccagtgtgtccatgctggggccagctccacacccaccatcttaagagccagctcctccatccccgtggcccagtcttcttttctccatgatacttatcgcaacctgaaaccatcatgtctgtgtatccgtgtacgtacactgactaccccctcccaacacgaacaacactcagggacagcagggaccacacgactattgaatgcccagccctagagtgacagctggcccacaacagtgcacaggaaagatttgttagaaggacgagtcagtcaaatcagtggcttttgaagattaagaaaataaacatcttactatgatttttgattaagaattaaaaggtgatttcctggcccccttgaaaagcactgggcacatcttaatgaatgcacaatgtgtccaatttgatgtgaaacaaaactatcaatttggtgtcagaaccacaagttgtgtggca

SEQ ID NO: 4275 - DNA, 1660 bp, Homo sapiens
ctcccaaggtgctgggattacaggtgtgagccactgcacctggcctatataggccttttccttaaacctatttagtaatgttttcccaagtttattttttatttttaattttttccccaagtttatttttctatttttttttcatggaaaaatggggtaacttagcagtttcaatattgaagactgaagtttaaaaaacatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtgactgaatcagcagtgcctgccctagtcatagctgtgcttcaaaaacctcagcatgattagtgttggagcaaaacaaggaagcaaagcaaatacagtttttgaaattcctatcctgttgcttgaactattttgtaataattaaactttgatgttgagaaatcacaactttattgtacacttcattgcaacttgaaattcatggtcttaaagtgagatttgaatttctattgagcgcctttaaaaaagtaataccaaaccataaagttaaaatctatgtatattgagtcatatctaaaaccacgtataaacataaattgtatttcctgttttaattccaggggaagtactgtttgggaaagctattattaggtaaatgttttacaaattactgtttctcactttcagtcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccatcaaaaaaaaaaaaaaaaaaattgcatgtcaaaaacattaaaaatcctataatcttcaaaaaaaaaaaaaaaaaaaaaaa

SEQ ID NO: 4276 - DNA, 4569 bp, Homo sapiens
ggatccttacaatggagatagtggggccaggcatggtggctcatgcctgtaatcccagcactttgggaggctgaggcaggcagatcacttcagtctaggagttcgagaccagcctggccaacatggtgaaaccccatctccactaaaaatacaaaaattagccaggcatggtggcacgcacctgtaatcccagctactcaggaggctaaggcaggagaatcacttgaactcaggaggtggaggttgcagtgagccgagatcgcaccactgcactccagcccagcaacaaagcaagactcttgattcggaaagaaaaaataaaaaaaggttgggggagacagtgggagcccagacttttgtccttccccttgcctagaagggagatgaggttgctggtgctgtggaagctattatggaccatgaggcagctttgaagacagaaagcctgcatccttgatgactcaatggaatttcatcccaacccaggactgactgccccagatctttgttacatgagggaatacactcttctgtgtttaagaaactgtggttggatctgttactggaatatgaatgcagttaataactggctcaaaatgacttcatctcaacccacattggttgcttcttccaaacaatatataggtctgtactgtggtgggtctcaggatggctgtgatgtagccttaggaagtttatctatgggaaatccatattcatggtgtcctgatgttgcagaggacatcctgagctggctggagtaacttgggacacaggtcaatcgactgtaatctaacttctgaggccattcagtaccctctacagtggccacctaaaaaaaaggcagccaggtgtggtggctcaagcctatatagatcccagaactttggaaggctgaggtgggaggatcacttgagccaaggagtttgaggccagcctgggcaacatgaagaaactctgtttctacaaaaaataaaaaaaattagccaggcatggtggtatgcacctgtagttccagcttcttgggaggctgaggtggaagaatgacatgagcccagcaagtcgctgcaatcagccgtgatcacgccgctgcactccagcctgggcgacaaaaagaaaaagaaaacggagcctgttcactgggtgtggtagacaaggtaaacttttctttacctcccatatcccacaaccttggatgtgctcacagtcatggtagtgttttgaatgatgtagctgatgacaggtgtgatgttggagattctctacctgactgctgctatcagtctaccagcccccaacgtttggtgcttgttctaaagggcatgtcctaggagtcgctttaaagagctcagcctcccaataggaatatttcattatcactagatcaagtctttccattacaatgactgatctgtctctgaatcctgtggattcatccttcaaaatgcccttttcttccagttctcatagctagtgcccttaaaagtgacctgcagtacctcctgctgagacgaatgtaccagcttcctaactagcctgcactcccttcatccccccaagtcagtgccagaccaccttgcctgaaaaaccactttcagtgtgtctcacctcagcagaaatgtttctcagcttccaattaacaatcacatcaaacccctgctcttgtctgcgttttaagggtatctataggccgggcgccgtggctcctacctgtaatcccagcactttggaaggccgaggcgggcagatcacttgaggtcaggcgttcgagaccatcctgaccaacatagtgaaaccccgtctctaccaaaaatacaaaaaaaaaaaaaatagtgggcgtggaggtgcacgcctgtaattccagctactcgggaggctgaggcaggagaatcgcttgaacccgggaggcagaggttccagtgagccgacatcgcgacacagtactccagcctgagcgacagagcgaggctgtgtctcaaaaataaataaataataaatttaaaaaaataagagtatctataacctggtcccagcctgaatttcctttttcacccccaacacgtagccctagttacattcttctgacgtctgtaaacaagcccagcccttcctgttgtgaagccaagttcaggtggttcctcttcgcctgactgttttcccattccacttaccggaagcctagtcatccttcggagggctgtacgggggttgcaagaagcaacggaaacggttcagcacctgctaccttccatcatattcttttcaataaaggggcaactcccgcaatggcagtgtagatttcctaacctctacacatggaagattcacaccattcaggattgttgtttaactgttgagagagcacttgatacttaacagcttactaggctacaagacagcgcaggaaagaatcctctgttgtccttttatgttatcctgaacagttggttcacagagttactgtaaacacacaaaacatgactgccagggcttagtagtgaggaaggtgggaactagtcctgactcagttaactgtgcccaggagaagctgcttaacctcaaaggatttcactattactagaatcaataataccaaccctaggggtaaaaataaagataaatgtgtgcaaatcctgcctgcagtctcgggcacgtcgtgggtgtccaagaactgttcttaggcagccggtggggacaaagtctgtgtgcctcctgtcctggaataggtcccaaggtcggcttacttgcaaagcaagggtacggcgcaagagtactgaatacgggttggaagggcgctggctctaccctcagctcataggccggctgggcggcgctgaccagcagctaggccccgtcttccctaggaacggccacgggggccctgggagggtatgaatgtctttttgcagtgaggcctctggaccccgcggccccccggcagcgcaaccaaaactcaggggcaggcgccgcagccgcctagtgcagccagatccccgccggcaccctcaggggcggacggaggagggccttcggccgtaccaactccacgggggcaggggccgcctcccttcggccgcgcgccactcaagtacggcagacaggcagcgaggttgccgaggccgaggctagcctgcagcctcctttctcccgtgccctggggcggtgtacggcaagcgcgggcgggcgggacaggcacgcagggcacccccggggttgggcgcggcgggcggggcggggccgcggggggagggggcggggcggcggtgcccttgcggcgcagctggggtcgcggccctgctccccgcgctttcttaaggcccgcgggcggcgcaggagcggcactcgtggctgtggtggcttcggcagcggcttcagcagatcggcggcatcagcggtagcaccagcactagcagcatgttgagccgggcagtgtgcgggtgagaagaaaggggacccggtcacggccccaaggggcaaggggctcgcggcgggcagggcctccgcggcaatggcgacagtggccgcaccgggcctggcgggaccggggcacctgcaggcggttctcccgggagtgcccggcgcggcggctggagcggggatccgcagggaggggacgcggggactcgggggacgccgcgcgctgccgttcctcggcagcccagcctgcgtagacggtccccgcggcgctgactgaccgggctgtgctttctcgtcttcagcaccagcaggcagctggctccggctttggggtatctgggctccaggcagaagcacagcctccccgacctgccctacgactacggcgccctgggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgaaaaaaaaaaaaaaaaaaaaaaaaaaaaaagtagtcgaccatgcgaattccatcaagcctggtacatactgaaaaccctataaggtcctggataatttttgtttgattattcattgaagaaacatttattttccaattgtgtgaagtttttgactgttaataaaagaatctgtcaaccatcaaaa

SEQ ID NO: 4277 - DNA, 1464 bp, Homo sapiens
  misc_feature (1)...(1464): n = A,T,C or G
cgcggccctgctcccggcgctntcttaaggcccgcggcggcgcgcaggagcggcactcgtggctgtggtggcttcggcagcggcttcagcagatcggcggcatcagcggtagcaccagcactagcagcatgttgagccgggcagtgtgcggcaccagcaggcagctggctccggctttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaaaaaaaaaaaaaaaaaaaaaaaaaaagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgcaaatagagctgtatactgtttaaatgtagcaggtgaactgaactggggtttgctcacctgcacagtaaaggcaaacttcaacagcaaaactgcaaaaaggtggtttttgcagtaggagaaaggaggatgtttatttgcagggcgcn

SEQ ID NO: 4278 - DNA, 1023 bp, Homo sapiens
  misc_feature (1)...(1023): n = A,T,C or G
tgattccnttggcgcctnctactactatgctgcgagaagacgacagaaggggactcgtgggctgtggtggcttcggcagccgcctcaacccggcggcggcatcagcggctaagccagcactagcagcatgttgagccgggcagtgtgcggcaccagcaggcagctggctccggctttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaacgtgactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgatcataccctaatgatcccagcaagataatgtcctgtcttctaagatgtgcatcaagcctggtacatactgaaaaccctataaggtcctggataatttttgtttgattattcattgaagaaacatttattttccaattgtgtgaagtttttgactgttaataaaagaatctgtcaaccctccaaaaaaaaaaaaaaaaaaaaaaaaaaa

SEQ ID NO: 4279 - DNA, 1984 bp, Homo sapiens
gggactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggtaggttccaggctgagcggcgggaggcagtccccggcagaggcgaccccagggagccaggccccatacggacgggcctctccgtggaggagaactcgcttcgcatttgtaccggttccgagttttccaggcacgatagtctctcttttaaacacatggtctacctcattgtagaaggagtgcctcgatgggtttgaacacacttctgtcatctcagggaacttggggtcctgcgaaggagcttgccttactgttgtgagccacattccgttacacatattgccagcactggtgaattgtagggcctgaaaagaaagctctactgtgtcactcgttttttttgcaaattgaaattgttcttgttgtataatgtgctttggggaaatgtttggtctctcaggtaggtgtgccagccgtttgcaggagggctgagagcgcctgtccactggtggccagacatcatcgggtccgcaggtgtctctgagtgtcagggtcacctcctgatagaagtgggagtggtgtcttactgccaggtcacactgaaggtgggagacaggaggacactactccgtgctaggaaccatggtccttgtcatcttcctgagagcaaacggggtcgggactccagcctaggacttggagactccctgcatccccagctaccctgcaggtgaaacttcactgagcccacttgacttcaggtgggagaggaggaggcacaccgttgtggtgtgcgttaccaaaaaagcagtaacctaactgtggaacagttcaggatctttagacttgatacttttcttgatttcccttaggggtcaaagttcacaaggaaaatagccctttagtgggaaactgaaacaggcttgtttttatttactatttactcatatttgtaatgcaattaaaatatatgttgttaacttttttttttttctcaagagctcggttgataaaaccaggggtatgtggactttttgagtctgtgccttttgggggtgtgtatgggaatgttatgttttaacgttttttacaaaatagaattgtctttttagtctattcgttagtggtttgcacaaggaagataatcgatagtcatgttttttagactctctgtattgcttggtaagctacgtagtaaaaaatgtttacttttccttaaatgttttgaatttcggggttatgaaatttgttgagtaatttttagacagtcacatcttgttgactggaggcatctagtggaaaaatgcagtatttcagcctgattgtgtttgaagtaaatgattaaaagaggaggaagttaccacattctggaagatttacttgagacagacgaaccttgaattacgggaaaaggccccgtgatttaggaaataacaaatttgggaaacatgtaatggggagagactggggaataccccagttgtgaaagtacttcctgtaaggcaacatctgacaccaggaacctttctcttcagtattttaaaaacaacttaatttcagtcctttacttgtggaatcagagccttacttatgtaatacaacccactggaaaaaagctttttattgtattgtactatattgtttataagtgattgagtacctgcagagctttcttttacttaaacatattttaaaaattattaaaaagattttcatgtttgaaaaaaaaaaaaaaaaaaaa

SEQ ID NO: 4280 - DNA, 886 bp, Homo sapiens
gcgtggtagcatgcacctgtaatcccagctattcaggaggctgaggtgggacaatcacttgaacccgggaagtggaggttgcagtgagctccggtcacgccactgcactccagcctgggcaacagagcaagactctgtctccaaaaaaaagaaaaaaaaaaacgcctatataaagaaaatattcccaataggagataaacctatgtacacagagttgctcaccccagcattatctgtagtaacaattagaaacaaatgaaatattcaaaaacagtaaattaggcagatgatgaaacaacatggcaaatgtatgatgctaagccaaatatacaaaaagatccctgtgagacggagcagggacccctctttggggtgtgccagggggattcccacaagcacagaaataaaggagaatcttgagtttccttcaccgaaaactccaggcacccagctcgccccgagaaggaaaccagcaagctgataagcaagaaggtcataacagtttcaaacaatagccagggaagttagagtcacctagagacatccttaacacgtgcccctgagctacttttcagaaacccagacccccaccaaatggattcacacagacgtcagataagggggaacaccagggactaaactctgacctccattctttgctctcagtttcttcctgaggggcctggccagaccttaatgttcctttctgcggaccccaagtttttagacaaagctttgcttccttaaccaatcacaaatcagggagtctttgaatccaccataacctgtaagcccgccccctgcctaccccacttccacctttcaggccaaaccaatatataagcttcatgtagtgatttacaattttggtatacagccataccac

SEQ ID NO: 4281 - DNA, 624 bp, Homo sapiens
  misc_feature (1)...(624): n = A,T,C or G
ccaaaggtcagttctgaacctatcaatgtgacttggttccttgcaactttatgcagaagctgcggctgcatctgtttgtgtccagtgctcagctcgtggtaggattggtttctataagggtgccgcactcttgcgaatcactgcttgtaccaatcagtatcctctgcaaggatcacacggccttatcacactgctggggattgatgtgtgggacagcgctttcccctttgagtataaaaatgtcaggcctgatcatctatgagctatttggtatgtacatcgcctgggaggaaggacatggcatatacatggcttgcaaaaagttatcctacgttcgttatgctgagtatgttaagctctttaggcctgtttttgtagtggtatagagtcctgcaggacacatgtaagctgctctattgtagcatttctgtgatgttgcttagtctcttttttcataaacaacttaatgtcctgaataattccttcactaaacattttgtttttgggccagtgattgaaaatagtaaaatgctttgtgtgantgacnctgaattgggccattttnttcnagagagcttanatnncaantttgtcaatttatgaaacccntcaaaaaanaattnc

SEQ ID NO: 4282 - DNA, 487 bp, Homo sapiens
taattttgggatcgggggggtgctgaattttaggacaaacggatgttatagataagctggtcccattatctaatacgttacaaagaaaaaaatataatgtatacagtggttgaaaaagtaggagttacaaaaaaatgtgtttgcattttaacttttcaggagatgttacagcccagatagctcttcagcctgcactgaagttcaatggtggtggtcatatcaatcatagcattttctggacaaacctcagccctaacggtggtggagaacccaaaggttggtatatattggtgcacccttatctacattttgtgcacagtaggaatcgattgttgatttactgaagttaccttatacttgttttttgtttttttgttgttgtttttttgagacaagagttttgctcttgttgcccaggctggagtacatgcggcgatgcttggctcactgcaacctccgcttcctgggtcaatgagttctcctccgc

SEQ ID NO: 4283 - DNA, 378 bp, Homo sapiens
acctccagccttatctgtggttgatgactcacatgcgtgtggctggaagcctctaatcttgactctggttcctttgacaagcttaaggagatgctactgcatccatctttttgcactccaatgctttggttgggttggcctgtctctatattgaacgggacactcacaaattgctgttgtcctaactcaggatccactgcaaggaacaacaggccctatctcaccgctggggattgatgtgcgggagcacgctcactaccttcagtataaaaatgtcaggcctgatcactcaaaagttattctggaacgtaatctacggggagaatgtaactgaaagactacatggcttgcactaagtaaactacgaccgttactgct

SEQ ID NO: 4284 - DNA, 409 bp, Homo sapiens
atttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggattacaggcataagccatcacgcctggccaaatcatggtttagaaaagggagatggtcaaatataattgttatgactgccatagtacctactatgtcccagataatttgcctaggtttttaaccctcacaacacatccctaaaacattgtacagatgcaaatgcagaggcacgaagaggcttaaaacattcccaaagtcacatagttactataaagccagtaactggctctatgtctaaa

SEQ ID NO: 4285 - DNA, 364 bp, Homo sapiens
actagggcaggcactgctgattcagtcacaaaaacccttcttggatgaacaatacttgttcttttcagaagaaaagcaattttaccttttctatttctattatgaaaaacagagctaaacaatttttgtatttttagtagagacagtaaattaggcagatgatgaaacaacatggcaaatgtatgatgctaagccaaatatacaaaaagatccctgtgagacggagcagggacccctctttggggtgtgccagggggattcccacaagcacagaaataaaggagaatcttgagtttccttcaccgaaaactccaggcacccagctcgccccgagaaggaaaccagcaagctgataagcaagaag

SEQ ID NO: 4286 - DNA, 337 bp, Homo sapiens
  misc_feature (1)...(337): n = A,T,C or G
ccagacaacttatattcaaaagctcatctttcaaaaggttccaccttgcccgtttatttaaacagtcacgaccttccttattagagacaagagtaccaaagcggtgtgtgtatgtttntntgtgtatgcatgcttgtggattggaaaaactttggagactgattacttttcattatatatggttcacantgaaacaccttntnnttntcangtaagattactgcttgcccgtttanggaagcangcacnnccttanatagaggggcaagcagtaatcttacatgtcacataaaagctgtttcactgngacacgngaatttcgagtatccaaggcatt

SEQ ID NO: 4287 - DNA, 285 bp, Homo sapiens
  misc_feature (1)...(285): n = A,T,C or G
attaaaaatgtcatcctggccgggcgcggtggctcatgcctataatcccaacactttntgggaggccgaggcaggtggnttacaaggtcggnngatggagaccatcctgnccaatacagtaaaaccctgtctcttctnaaaatacaaaaattgtttagctctgtttttcataatagaaatagaaaaggtaaaattgcttttcttctgaaaagaacangtattgttcatccaagaagggtttttgtgactgaatcagcagtgcctnccctagtnatagctgtgctt

SEQ ID NO: 4288 - DNA, 236 bp, Homo sapiens
  misc_feature (1)...(236): n = A,T,C or G
gagcggcactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccncgacctgccctacgactacggcgccctggaacctcacatcaacgcgcagatcatgcagctgcaccacag

SEQ ID NO: 4289 - DNA, 339 bp, Homo sapiens
gcgtcgacggctgcagaagacagggagtgagaagggcctctgtcccccagggctgcacagaggatggtgtggccaagacagagcaggctacagtggacaggcaagcggcagggctggtgctgagtcactccacagtgtcgaatctactatctgcaggatgccagggacaccagataaagatgtggtccaggccgggcatggtggctcacacctgtaatcccagcactttgggaggttgaggcaggaggatcactcgaggccaggagttcaagaccagcctgggcaatatagcaagccccatctctaattaaaaaaaaaaagtcgacgcggccgacagtt

SEQ ID NO: 4290 - DNA, 463 bp, Homo sapiens
tttttttttttttgcagttgatattaatttttatttaactagttgatgtttaatccgtcacgccaggctgggtagcggcgagaaagatcttcctgacacaaaaccagttagaacttcataaggcacaatcagtgtccgcgccttgaaacaaacaagagagacagagacagagagacagggagagacagagagacagagagacagtggcagccctgccagagatggagtcggagacagagacagagtggagggctgggagagagctaacccagggcaagagctgggggaaaataaactagaaaggcagagagctcagacagctggcaaggggctgacagccctgaacctgggctccaagcccaggacagccccgacttaatagggaccaggagaccaacgccctgggaaagtccggccagggcagtggtggggtggtcgaccagggccctgccaagcctggccg

SEQ ID NO: 4291 - DNA, 524 bp, Homo sapiens
  misc_feature (1)...(524): n = A,T,C or G
cccccaaaaaggaatcnggtttgtaaattggnattttaaatacaaagaagttttcccnaaaagnccccctgaaaacacttgtgtcccaaactcccatgcccccaaatttaagttttcgctccctaaaaaccaactcgaggttatgtggggagctaaacagggtcaactaagagcccatgtatttgggtgttgtgagcaggaccagaaaccatgtcctccatccctcccaggttgagacccaccatgggactggcagtaagcaccagcttattttttttatagagatggggtcttgctatgttgtccaagctggtcttgaactcctggcttcaagcgatcctcctgccttggcctcccagagagctgggattacaggaatgagccactgtgcccagcctaagctttctttactaaagaagacttcatgaattcctgtgtatccttcacatcccagctaagaggccattgtactgtgaaaactatgacacttcgaaaagcggtaccttgtcttctggtgccgaaat

SEQ ID NO: 4292 - DNA, 515 bp, Homo sapiens
  misc_feature (1)...(515): n = A,T,C or G
nttacactgntaanccaactgaatctactcggtggggagagggccagtttgaaatattaaatagagtggnccnaaatcancctcattgagaggntgacattttanccnaagacttgnaagaagtgtagaagtaaatcatacaagatacatgagagnnagtgtcttgcaggcagagtgaatggttagtgccaacacctaaggacagggcatgtccaacatgtccnaggagtgagaaagacaccagaggggctgccttgttgtgaggggaaagaatagtaagatncgaagtcagaaacgaggtgggggaccggatcacacatggccttctaggccattgtaaggcttctgcccttgcttggtaaaatccaaagccctcacagtggcctagaaggccatgtgtgatttcggatgaagattaagcatttaattttgcacatattggatttgagatgtcaactagataggctagtgaagatgaataggcgcttagatnatctatgcanccccccccccnn

SEQ ID NO: 4293 - DNA, 436 bp, Homo sapiens
tattttttttttttttttttttatgtgttgtcgtgcaggtagagtgaatggttagtgccaacacctaaggacagggcatgtccaacatgtccaaggagtgagaaagacaccagaggggctgccttgttgtgaggggaaagaatagtaagatacgaagtcagaaacgaggtgggggaccggatcacacatggtagcaaaaatagtagtgattaagggtgcaggttctgtagtcaaaacgttttgttttaaatctgaactcatcaattgccaactgtgtaattttgggtaaaatatctaatttctcagtgacccatagtcctcttcacaccccacctcagatctgatgtatttatcacagttctccagagaaacagaatggacagaatatatatatatatatatatatatatatatatatatatatatatatatatat

SEQ ID NO: 4294 - DNA, 572 bp, Homo sapiens
  misc_feature (1)...(572): n = A,T,C or G
ttgccttaattgttgaagggtatttttgctggatatagaattctggattgacatttctctcagtactttaacgatgttctgtagttacttgaatcgctgaaaggcttaaagttggggaccagctctatcacctatacattttatagaaaggttcattactttcatatcttcattgtggaccatagcctttatcatcacaaaatttggtctcatttatgagtttttaaattttgctttgaacctaaacttttataactcctttctatttcctacaatgtgggagtttatgggcggacagcacagggcagttgggaaatatatatctgggagtttaggaaaagagggtctagggtaggggaaaatgggatcctaggaaggtcattggatattttgggcccgggcgccggtcgggcccccatgcccccggtaatccccagcctcttccctcctatcattttacgtggttctgggagacagtaggccaactnggcccgggggntttgacataaacctaggttctncataagggaagncaggggggccaaaatgaggttctggggncaaacctaaag

SEQ ID NO: 4295 - DNA, 493 bp, Homo sapiens
  misc_feature (1)...(493): n = A,T,C or G
tgccttaattgttgaagggtatttttgctggatatagaattctggattgacatttctgtcagtactttaacgatgttctgtagttacttgaatcgctgaaaggcttaaagttggggaccagctctatcacctatacattttatagaaaggttcattactttcatatcttcattgtggaccatagcctttatcatcacaaaattttgtctcatttatgagtttttagattttgctttgaacctaaacttttataactcctatttcctacaatgtggagtttacggcggacagcacaggcagttggaaatatatatctggagtttagaaaagaggtctaggtaggaaaatggatctagaagtcattgatattttggccgggcgcggtggctcatgcctgtaatcccagcactttgggaggttgaggcaggctgatcacaaggtccaagaagatttgaaacccatncctgggccaaccatgggcgaaaaccccgtt

SEQ ID NO: 4296 - DNA, 495 bp, Homo sapiens
  misc_feature (1)...(495): n = A,T,C or G
cctgcccgaaggggnaattttgccgggaaaaaaaaaatcccggnaatgnaaaattncccccaaagtcctttaancgaaggtcccggaaagttacctggaaaccgcctgaaaagnccttaaaagttggggnaccaagctcctatcaccctatacattttatagaaaggttccantacctttccatatccntcattgtggacccataacctttatcatcacaaaaattttgtctcatttatgagtttttaaattttgctttgaacctaaacttttataactcctttctatttcctacaatgtggagtttatggcggacagcacaggcagttggaaatatatatctggagtttagaaaagaggtctaggtaggaaaatggatctagaagtcattgatattttggccgggcgcggtgctcatgcctgtaatcccagcactttgggaggttgaggcaggctgatcacaaggtcaagagattgaaaccatcctggccaacc

SEQ ID NO: 4297 - DNA, 374 bp, Homo sapiens
  misc_feature (1)...(374): n = A,T,C or G
nntnttttttgagacagggtcttgctccgtcacccaggatggagtgcagtggtgcaatcacagcccactgcagccttgaactcccaagactcaagccatcctcccgcttccacctctcaaagtgctgggattacaggcttcttgtgtgaattgcctgctcatgttccagcaggaagccgggatggaggaggagccacccctgggggttccagggttgctgctgtgccctgtgcctgggaacagagtaggcgctccgctaatagctgtgaggcccaggcatatgccgggggttgccgtcaaaggcattgcaggtgctaacaggccggggcccgggcgctgaggtctccgacgtggggtggaggacagctcattcg

SEQ ID NO: 4298 - DNA, 835 bp, Homo sapiens
tttttttttttttaagcaacattctttctttaatttccctttgcaaatggaagcccctgagctggtgcccacccccacccctaccccataccctggggacccccgatgcaaggcccccacctcaacctggtgggaaaagaggagcaccccctccctatgatggtccattaaaaaattcctagtcatttaagaaatgaggctgggaatgggagaaaggaactggaagacaaggcccaggtcaggccagtctgaagatgttggggttgtgagacccttgagaagggtttgcaagcacatccctaagctcggggccagcatggctgaaggaggagaggtgacacacagacagatagtctgatttcctcaaggtcctgcctgcctggctgtactgtagatgctgacatctcaccaccaccaccaccaccaccacaccaccaccaccaccaccacaggcctcctgatggagaattttccagttactctgggattgggtttgctaagcatcccctctggcccctgatctggggcatccctggggtccccctgagaccaaacctgggagaaggagggactctgggaacatgcaaagtgggggagcagagaccccgccccaccccgctgctctacaggatggtggctccagctgcatctgggctccgagggtccttaacagcgatgatgaagttgttggtccttcggctgccatggacccaggataagacatctactttctccacgtggtgacccctggcttccaggaactcaatctcttcctctgtgaactcactgtccacctgcaggaggttggactgcaggtccgggtgtaggcggccgc

SEQ ID NO: 4299 - DNA, 323 bp, Homo sapiens
gcacgaggaaagtttgaagaatgaacaactgtgtcttattttacaaatgagaaaactgaggctcagagttgagacatggatttcccaaggccacacaaccaggaaatggcaagactggttccaatccccagatcgttcactgctccaatagaaatttgccaaataaaaccatacttcactggcagttggtgctggttgaggcatgggcacccttgggaggagtcctttctctacctgtccctgtgcccgccccacgaggtctctctctgcactcactgtccacctgcaggaggttggactgcaggtccgggtgtaggcggccc

SEQ ID NO: 4300 - DNA, 374 bp, Homo sapiens
  misc_feature (1)...(374): n = A,T,C or G
catttatttatttatttatttatttatttttagagacagggtctcactctattgtccagtctaaagtgcagtggcgccatcctagctcactgcagcttcaaactcttggactcaagcgatcctaggaagaaaggaagaaatgtaattctcactattaaaacaccattactgcatactttttcaagagctataacagacttcatatctgctccaaaagcaaagtagtaaaatttttaaaaagaaaaaaaaaagaaaagattttatagaataaatgactttgaaacaatcattcaaatcttctttccacacatctcagggtcctccaataaatttgggaacccctaaaattctggaggttgcttggggnggtcccc

SEQ ID NO: 4301 - DNA, 478 bp, Homo sapiens
aacatggtgctatctctactgcagtattctagtattttttaacaacacgatgacttcactttcttccattggccaatattttgataaaacaagtattatctattattattattctttagagacaggatctcactgtcacccaggctggagtgcagtggcaccattaaagatcactgcagcttggaactcttgggctcaagcagtcttcctgcctcagccttctgggactacaggcaattttgagttttcaatagcttcatatgtaactcaagtaggccaggagacctaacattcatgactgttgcttaaaaaatatgaacccaggcagggcgcagtggctcacacctgttaaacccagcactttggaaggctgagacaggaggatcacttgaggccaggagtttgagaccagcctaggcaacacattgagaccctgtctgtattttacacacacacatacacacacacacacacacac

SEQ ID NO: 4302 - DNA, 372 bp, Homo sapiens
tttttttttttccccccttctacctatcatactaagattggttgttctggtagaatttattcctgtccaatttatttagctagattcctgcctaacattctcagctattatcgttcagcccctgttctgatcatccaatgctctgagtatttattcctcctaaatttgtgtcattttaaaatttgaggccaggctcatgcctctgtccccagcactttcggaggctgaggcaggaggactacaggcaattttgagttttcaatagcttcatatgtaactcaagtaggccaggagacttaacattcatgactgttgcttaaaaaatatgaacccaggcagggcgcagtggctcacacctgttaaacccagcac

SEQ ID NO: 4303 - DNA, 505 bp, Homo sapiens
tcttttaaagctcctgcttttgtgtccgactgaggtctcctttttttttttttttcccccaagcgtttgtccatcatgtggcatttctgggagctcgggactccactctgacagaggagagaggccatttcttttactgtctcctgtctctgaagagaaggatgaagtaaaagttgaaaaacaacaggaatgaagtcagcagcaagaccagccggtgccaccgatgaccaggcctgaggttaaaagattaccccccctcccactctaaccacatgtgatctcaatctatcacgaccctttcacgtggaccccttagaggtgtaagcccttaaaagggccaggaactctgttttcgggggagctccggttcttgagacgcgagtctgccgaagctcccggccgaataaagccaaatccttccttaacctggtgtctgaggggttttgtccgcagctcgtcctgctacatgacctgcctgtctatcctcttacccgacgcaacctgc

SEQ ID NO: 4304 - DNA, 515 bp, Homo sapiens
aaagctcctgcttttgtgtccgactgaggtctcctttttttttttttttcccccaagcgtttgtccatcatgtggcatttctgggagctcgggactccactctgacagaggagagaggccatttcttttactgtctcctgtctctggaggcctttccacttggagtcgtcctgactttctggatcaatccaatgcacacctcacatgtactgactgatgtcttatgtctccctgaaatgaataaaaccaagcagtaaaacaaccgccttgggccaagttctcaggacgtcctgaggctgtgtcatgggtcatatttggctcagaataaatctcttcaagtattttacaaagtttggctttttttgtaaacaataggcagatataaattccatttgctaatttttttaaatgctgtgtcttggttcatgaaagacattggtctgtggttctactgtctggtgatgtctgactttgctatcaaggcaatgctggcccatacatcgagcagggaagtg

SEQ ID NO: 4305 - DNA, 427 bp, Homo sapiens
tccaacaaccgagctccccaagtgagcaattcctgtcccttttaagggctcacaactctaagggtgtccgcttgagagggtcgtgatcaattgagcaagcaggggtacatgactgggggctgcatacatcggtaattagaaagaaactgaacaggacacggatcttcacagtgccttttttatgcaaataactgattaggtcaggggtcgatctttaactaccaggcccagggtgtggcaccaggttgtctgtttgtggatttcatttctgccttttagtttttacttcttctttctttggaggcagaaattgggcataagacaatataaggggtggtctcctcccttattccccccatttgagaatctcactcaatagtgggagttctcactttcatcctcactacccatgtcttcttgcaagaca

SEQ ID NO: 4306 - DNA, 624 bp, Homo sapiens
caggaaggggtgtgctccgaggcgtcagggcccagggccactgtccttgggtcccctccggtcctccgctttgccgcggaaaaaatattttggattccttgctgcccctcctgcaaggccccctgttgccccacacacccagagccgccaggctgaccggggtgaacagccggcccagccccgcgggcagtttttcttacaacgcctacacaatcgtcgcttgttccgacaaggacccgccgtggccaacggggcaggaaggctctgctttgccccgccccggcactagagccccggcagcctcatcccgggaaagaggggctgacggacacccagacacaccccaccactaccacgagcaaacccaccctgacacacacacggatacacacgggtgcatgcgcgcagacacacacacacaccacacccgggcacacacacacggacacacaaagacacagacacagatagctcaaagggagacctcccctcatattgtcttatgcccaatttctgcctccaaagaaagaagaagtaaaatctaaaaggcagaaatgaaatccacaggcagacagccccgcgccacaccctgggcctggtagttaaagatcgatccctgaccta

SEQ ID NO: 4307 - DNA, 1494 bp, Homo sapiens
tactcctggatatttttttgtgtttttagtagagatggggtttcgccatgttggccaagctggtcttgaactcctgacctcaggtgatccacccgcctcgggctcccaaagtgctgggattaacagaacgtgaaggcacccacaaccagcctggatgattcttaagggcccttctaggaccaaagttctgggaatttctagcttattctgccccctcatagcccttggcctatctatctttatccacatgcagaaacatctggcaaccccacatggctgagatgacctggtcctaggacacccttggacagaagactggcctacctagcagacctggatttttcttcctgatctgctgcttccaagttgtgtgaccttggctaagtcacttaacctttctgattgtcatttcgctttttaataaagtgggtctggtgaacaagaaatgtaataaacacgtggcttgccattcaagagatgagtctgaccattcactttctgtgtgccagagaagagagatcatgggtatagaccagcccctggaaaggctgctttggtcaaggctgagagcagctttgctcaaggaaattattcacgaaggtgaccactgtctttctgacctggcacagaggaaatgttggctgtgaatgtgaccaatagaaagaagcccgtatttctcagtcagtcctagaaccctggtaagtaattaacagagaataaaaatgtgtttgttaaatgacaaagcagcagtttttcaattgtaaggtctgcttgagagcctttgatgtgtgtttcttttcctgacttttcctttctttagaatttttgatggtctcacctggtgggtggggctttcagggtatgcccacaatgtacatttctcggcatctgtgcctcagtttcctcatttataaaatccctatgatctctgtctcacctactttacagggttgctgtgaagatcgcatactacacacaggaatgctcatcagtttttaaattttatttaatttttatttatttttttttaaatgtaattttttcagagagataaggtcttgctatgttacccagcctagtcttgaactcctggcctcaagtgatcctcctgccttggcctcccatgctgctgggattacaggtgtgaactaccatgcccagccagctcctaagtcttaaggctctgtgttagtgatagatgtggccatggtgtaggcagtgcaatgtcttcgagtgagagtgaaggtggtaactcattgcatggattctagagttctgtttattctaatccaagttcttccacttaaaaacaatgttcttcctctcattgagtctcattcctcatctataggatgggaataagagcatgtacctggcaggttgttgtaaggattaaatggtgtaaaaaaatgtcaagtgcttgcaactttgaataccaaacttgagtgaaagctcaataaattgttacttaaaaaaaaaaaaaaaaaaaaaaaa

SEQ ID NO: 4308 - DNA, 322 bp, Homo sapiens
  misc_feature (1)...(322): n = A,T,C or G
ctcgtgcgcntggagattgtgccattgcactccacactccagcctgggcaacagagcgagactccatctcaaaaaaaaaaaataaaaacaaaacaaaacaaaaaagagacacatcaggtgggctcagtggctcacccctataatcctagcactttgggaggctgaggcaggtggattgcttgaatctaagagttcaacaccagcagccagctcctaagtcttaaggctctgtgttagtgatagatgtggccatggtgtaggcagtgcaatgtcttcgagtgagagtgaaggtggtaactcattgcatgggttctagagttct

SEQ ID NO: 4309 - DNA, 717 bp, Homo sapiens
ttttttttgtgagcaacaaggctgtttattcacttgagtgcaagtgggctgagtctgaaaacagagtcagtgaagggagatggggaaggggttgctttataggagttgggtaggtaatggaaaattacagtaaaaggtggttatctattgttagcagaggagggggtcacaaggtacatggtggggagatgataagacccattgtccagaagaagactgtcacaaggtcgattgatcagttaaggtaggacagggacaggtcacaatggtggaatgttgtaatgttggttaatcagttaaggcaggaactggctgttttacttcttgtgtggtttttcagctgccccagacttcttggctcctgcaggccatctggacatatatgtgcaggtcacaggggttacaatggctgagcttcggctcagaggcctgacacctcttacttctgagggattgctcaaggtagaaggttaataaattcttaaactaccccccactttcactacagagattaagagtacagttctgtccaaggatttgatctggcccaacaaagagccttcttcagaagtggattagttttgtcctttggtgaggcttgtgatgggccttatttattcgtattgtaggcctcttatactattccaaaaacaagacaagggaactgaaaccactttgcataataatgtcacctattatctccagtgaggctagtct

SEQ ID NO: 4310 - DNA, 1033 bp, Homo sapiens
tttttttttaagagacaaggtcttgctctcttgcccaggctggagtgcagtggtataatcatagctcactgtaacctcaaactctcgggctcaagtgatttcctacttcagcctccacagtaggtaggacaataggcatgcaccaccgtgcccagctaatctatttctcgcagagatagggtctcaatgtgttgcataggctggtctcaaaactggcttcaagtgatcctcctgcctcgaactcccaaagctctgggattatagatgtgagccactgcacctggccccttttgattcctgatttttccttcctcacttaaaaatttacattgtggtctatggcaatagtctccacatcttagttctggtcctatagttaaacatctgatttacactgccagttctttttatttacattttccattcatcttcgtttgcgggaagccgtattttagtagattctccaacaatggttcacatttcctgagttcttgtatgttacaaagtgtttgttggatttatacatgattgatagtttggctggcaaccctgtaacatttgaatcctctcacaacatatgagaaattctggtcttattgatcccaccacctgaaagtagaaccaggaaaactccctagcagcctatgaaaggggcatataacataccctttttcaatcagatgtctttgtatgcaacttcttttttgaattcagcaatttagggaggcatctcatgcagaatccttttgttgctgttccggtgcgggtgggggcattcttctacctattcctgctgcagaagtggcaaaggtggggcagggaggcagcagcactttcttccagtgccctgtgtggcagtggagtgtcagcagcttcttccttagtccaattctaaggcatggttttacaaattgctgctggaagcttaccctcctggttcacctgccttctaataattccgtgagccaaacaaaattctttcaaaaaacttctcctgcttaatcagtctgtttctattgtttcaagcaagact

SEQ ID NO: 4311 - DNA, 410 bp, Homo sapiens
tttagagagagcgagtcttgctatgttgcccaggctggtctgtcttggcctcccacagtgctagggtcacaggtgtgatccactgtgcctggccgaggggtaaactttctgatatggattgagccagcacagaaccttccccaagctctactcttttagagacagggcctcgctcagtcgcccaggctggatggagtgcaaactatactcttaagtgacaaaattcacggcgcagagaggtgggtgtggcggggaaggacaccggtgaacacatcgccttgtaaggatggctgtccccggtggcccggaaacaactaaagcaggggcctgagaacggagggcagcgggactcgatcgggggcaggactctagcctcgaccgcactccctcccgtaatgtttgaggatttt

SEQ ID NO: 4312 - DNA, 410 bp, Homo sapiens
gctcgacgggagaactgctcaactctaccatatttttatttcacaaaaatacaaatatggccgtgctattgcataacctactggacaaaggcatcttgccatggcattggacttggtagcccgaggctgctttcaggaatgtaaggcagaaaataaaataaaaacaaaaaaagaggctaggcgcggtggctcatgcctgtaatcccagcactttgggaggccggggcgggcagatcatgaggtcaggagatcgagaccatcctggctaacacggtgaaacttcatctccactaaaaatacaaaaaattagccgggcgtgctggcaggtgcctgtagtcccagctaccagttactcagaaggctgaggcaggacaatggcgtgaacctgggaggcggagtttgcagcgagc

SEQ ID NO: 4313 - DNA, 334 bp, Homo sapiens
tttttttttgcttccacagggcttacccgggcctcctggaccaaaggtgagtgtccttctgggtgatgtgttgaacaggtgggagaattcccattttgaaggctgggaagccgatcagtcaaggggcccatatctggtgaggaccttcttgtctcatcccatggtggacagtggaagggcagggagagggcgagagaacacaagcgagagaaggctgggcttgctggtataacaaacccactgtcgcaatcacacacccactcccacaataactaacccacttccatgataactaacccactcccacaataactaacgtcgacgcgcctgcgaa

SEQ ID NO: 4314 - DNA, 549 bp, Homo sapiens
  misc_feature (1)...(549): n = A,T,C or G
actttgaaggccgagacgggtggatcacttgaggtcaggagtttgagaccagcctggccaacatggttgaaaccctgtctctaccaaaattccaaaaattagccgggcatggtggcacgcacctttaatcctagctactggggaagctgaggcacgagaatccactcgaacccgggaggcggaggtcgcagcgagctgagatcacgccacgacactccagcctgggcaagagtgagaccccatctcaaaaaaaaaatctgcctcagaccagaggccgtaatagattcttcctattcacaaaccaaagattggtttccactgtaatgctcccagggtctgcaatgtagcaatatgccaaacctgaaagtttctgaaacttcagccttaacaaatagcctgcagtcttctaggaggctgcttatcgagtaaagaggagcaccagctcacaatgtggggtgtgagggaacnaatcnacaggtacagcttgctgcagganaaagggctcgcctaagagcttcttagcagggtctggaggacagcacagcctgt

SEQ ID NO: 4315 - DNA, 437 bp, Homo sapiens
  misc_feature (1)...(437): n = A,T,C or G
tttttttttttttttcagttttcaatatccagtttattatgttatactagattttggagctttttgcctccacactacacagcacaattataggtattcagtctctctgaaaatctcctttcccttagggtctctccaataaccaattcttcctccacgggtgagagttaattggtgctattgctcctagggataactacattttcttttttttttttttttttgagatggtgtctcactctgtcacccaggctggaagtgcagtggcnaacctcagctcactgcaatgtagcaatatgccaaacctgaaagtttcnggaaactttcagccttaacaaatagcctgctgtnttctaggaggctgcttatcgngtaaagaggagcaccagctcacaatgtggggtgtgaggggaacaaatccacagggtacagnttgg

SEQ ID NO: 4316 - DNA, 503 bp, Homo sapiens
tttttttttttacagtcagttttcaatatccagtttattatgttatactagattttggagctttttgcctccacactacacagcacaattataggtattcagtctctctgaaaatctcctttcccttagggtctctccaataaccaattcttcctccacgggtgagagttaattggtgctattgctcctagggataactacattttctttttttttttttttttttttgagatggtgtctcactctgtcacccaggctggagtgcagcggcacaatctcagctcactgcaagagtgagactccatctcaaaaaaaaaatctgcctcagaccagaggcctaatagattcttcctattcacaaaccaaagattggtttccactgtaatgctcccagggtctgcaatgtagcaatatgccaaacctgaaagtttctgaaacttcagccttaacaaatagcctgctgtcttctaggaggctgcttatcgagtaaagaggagcaccag

SEQ ID NO: 4317 - DNA, 404 bp, Homo sapiens
  misc_feature (1)...(404): n = A,T,C or G
gtaantantnacagtcagttttcaatatccagtttattatgttatactagattttggagctttttgcctccacactacacagcacaattataggtattcagtctctctgaaaatctcctttcccttagggtctctccaataaccaattcttcctccacgggtgagagttaattggngctattgctcctagggataactacatttncttttttttttttttttgagatggngtctcactctgncacccaggccggagtgcagcggcacaacctcagcccactgcaacctccacctcccaggnccaagcaactntcctgcctcagcctcccgagtagctgggntcacaggngcccaccaccagggnaaactacattttcaaggggcnttcgagatgccttaaaacc

SEQ ID NO: 4318 - DNA, 660 bp, Homo sapiens
  misc_feature (1)...(660): n = A,T,C or G
tttttacagtcagttttcaatatccagtttattatgttatactagattttggagctttttgcctccacactacacagcacaattataggtattcagtctctctgaaaatctcctttcccttagggtctctccaataaccaattcttcctccacgggtgagagttaattggtgctattgctcctagggataactacattttctttttttttttttttttgagatggtgtctcactctgtcactccagcaagatgagactccgttcaatgacattcctagtggattcaccatggagcttgcaggaaacaaaaactagcgtgtggatggccctgaagtttcgaatggcttgaatcaccttgtaatgcagtccggcacgggctgggttcaccacagcaacaattgactgtccatcttcctttgactttagcagccctggcaaaatcttctctgcttgaccagtatgaaattcagagttggtgatgccattgaaggctgcagtccatcttgcatcctccactgcctgctccaacaattcaatcccaaggacccgagatgtatgctgagccagagagaggccaatcacaccagttccacagcagatgtcaagaaaggatggtgtctgtgcccactccagtcagctccccaacagtccgatacagcn

SEQ ID NO: 4319 - DNA, 2284 bp, Homo sapiens
tcatttattgcgctctaaagaacagctcgagacacacagtttttttttttttttattttttttttttcttgacccagttaaatttttattcagtgaaaaaagttgacattgagacaaaaattatcttaaagttgtgcaacaatacagtaaaaccttcagcagatttcagtgacttggaaacttatcgaggcaattgaaattataaatacttaatttcgctttggagagaaacaagtatacagtgtttcactttaaataagagtagaataggcctttattttgccgcaaatacttttgattttgcctaaagtttctaatagttcataacaagagtctttaaatgagaagtgacatagaatatttgaggataatggtccactccagcattcatgcttattccatttgagctattacacatgaaactcataccattcttgggttattacttggctgtgacgatttaattcataatatggctgctcaaaattagtgggcagaaacatacatacaacccatcctccctcaacccattttcggtgctggtactccatctgaaaacacacttactgtccatgtacccagcagtacatatctcttcctatctattccatatctcagtcttgcatagaaagtagtctatataaacttaatgcactggcttttattacacaaaaattgtacctgaaaggcagcacacactccagttaagaaaaataacacaacaggaatgtcaagatacaatcccaacacaagattctgcacagagttttagagtcaattcctaaaatcaatatgggatgatattcagtttagttatgtctctggatgccttctctaagggactcatccaactgtctgcagaaggaagaaaattttcaggaattccccatgactcccttcatgaagaagggactgaccaaacctgataggatggtgtttctgccctaaggaagtgtactggaaatataatcttactagatgcagtgaccacttggtaagcatctgaaggcagcattcgccaagaaggagtaggcgctcatctctaaggggctcaccatactattgctctcccaagcttcccctgaaaatggccagttctgagaagggttacattccctaaattgctgagtacagcttcatctagtgggccaaacatgatgggcaggagagaacaggcagctgtgtgtcttctgtctgtcccacccaaatatccctggtgatgctaccaaagacagaaccccaggaattacttgtccaaaagtcagagtttcaaccagttacccagaatgataactatttacccagcttgtcaaggtagccagtagttcctggagcttctcacctgtctggaactaggactgcacagacatggcctcttcctggaatcctctgtagaactccactctctaacattttatccatgtggactcgtatctcataaagctcaaggggcattcaatacatccaggagtaaaatcggtttccagagaaaactcataagcaaaccccctgcccaccaatttttagaggcccatcgtggtccacatggatgcaggcatctgacattctaatgtatgccaggagagaataaaacctttttcctgcacagtgtgaacttctgaggtggcatctccaacaaggtacaaaagccccttcttcacaagcaagcagggactccgactggtcacagtgaagacagttatctggtcaccttcagaggctgcctgtagtacaaggcatttgttttcattttctattggcactccaacctctggattctttcagacagcatatatacatgaaatccccacaaagctacacagagggaaacaggagtgtgtgcttcaaaagttcataaaaatatacaatttacatatagctgcagctatctagcttagtcttcaggaacttagctcttctgtttatataaaatactctagccctaaaaggctgctttttttcaaacagcacagtggcattttccaaggagaggggtgatggccagtctacagtactgtgcactaagcattgggaggcactggtagctagaaccggatgctcggaaatatctcaagctgccaactggagacatatgctctgtaaaaaggcttgcctatggaataactgaaaataacatctcagagccttttatatcagcttttacaaatgccaccaaaaagttggcagaaaaaaaaaaggaaatacacttcctagtggttcaattaaatgacttgcctcccaccaggttgttaatgattcaactatttaaagagcttattaaagg

SEQ ID NO: 4320 - DNA, 484 bp, Homo sapiens
tttttttttttgtttttttccagtcttactgtgctatgtcctttcagttcccatacaaaataaagccccatccagctgctggcttgaaattcccacattaccttgatatcactctccatggtcagggtgaagcttagataattttcaccatagctgtcaatgtggatatctggtggtgggatcactgaaaacaaaaaggaattcaaaaacagaagccacgtgatgaaaagtgaggaaggcaggacttaatagttttcaactcaacggacaaagccatctttcagtcggggaagaaagggtatttctttggcagtgttcctcatcgatctttttttaccactgttttcctgaagctaaggttggtccacagttgcttggtgaacacaaaactatcttggctcagtcggctatcctggcaattaggtcaggcagaaaagttccattttgtaaagggtcccaaaacagcccagcttcagcctggttc

SEQ ID NO: 4321 - DNA, 947 bp, Homo sapiens
  misc_feature (1)...(947): n = A,T,C or G
ggcccnaaaangnggtgntcccntgggaagggaaaanggngaggggcnttangggcaagggggnaattgaagggggggggtttananaaaangaagggaaanccccccccccnttngggngtnntntnggnnnnngnnttgnttaaaaaaagggggggggggggaannntnaanagnnattcccccnnnntttccccaaaancnnaaaaaaggnncaaaagnttttcaaaanaaatggaaccggnngaaaattttccagttcccaccccaaaaaagagtttcccaaacccccaaagaagggactcatcttcaagaccaaaaacctcccccttttccctcactttccatttttcaaacaaaggataaaaggatcgaattctcgttcttcccaacaataagtgcttacaacaagagagctcttctgacgcttgtatggtggtaaggagttttccccaaatacccaagttttagcacagttagaaggactcaaaatttgttctctcaaaaaaaaaaccactgggaacccccaaactgatttttgagaaattctgcacaaaatcttttcttctttccttttcccctctgttaaaactcaatgtcccttcctttttttttttcctttttgctccaggcacctgacgatttgttctgctcagtcagattcagacaggtgtctccgaagtaccaccgctgggatatcctcgggccagcgcctaaactgaatccccacagtatcaaactcagccaggccaaagggaacacagtgacgcagcaacagggttttcatttcattttccctccccccgtttcccccaagttatttagtgctgttttaaaggtctggggccacaatgcagtctcttcccctcacaacagagtaaaagctccacagatgcgcttctacctgtgtcatgcacacatgctctattcggaacacnaaaggnnaa

SEQ ID NO: 4322 - DNA, 865 bp, Homo sapiens
  misc_feature (1)...(865): n = A,T,C or G
ttttttttttttttttttttttttttttttttttttttacaaaatagtaattatttatattttcaaaaaaaaaaaaattaacatttggaagttctcccctggaggaagaggggctagtcagaaggaacagaactggctcctatgcaggcggcaagtcaggtacaaacagctgagcaatctgggctgggattttatcacacagcatttttaattgataaaatttccttctctcttcttttgttctgtttttgttttgtgtgtttttttttttgtttgttttttagaaaaaggggtgggggagaagaaataaaatcagagaaaaatgcccaaaaacattttccacaatatctaaaaacagagaaccatagttcttgtcaagacaatatgaattctggatgagttattttttccagttttcaacaccaataaagatttttgcaaaagccaccacatcagaacactcatcttccagatcaaataaccttccccttttgccttcacttgtcatttttcataaaaggataaaaggatgtattctgttcttgcaaacaataagtgctaacaacaagagagctcttctgatgcttgtatggtggtaaggagttttcacaaatatccaagttttagcacagttagaaggactaaaatttgtttctctcaatataaatactactggaatccacaaactgatttttgagaaattctgcaaaaatcttttcttctttccttttcccttctgttaaaactcaatggcctttctttttttttttcctttttgctccaggcacctgacgattgtctgctccagcagatgcagcaggtgntccgaagnccaccgctggatatcccgggccaggctaactga

SEQ ID NO: 4323 - DNA, 8604 bp, Homo sapiens
ttttttttttttttttttttcacagttgattactacaaagtttattcattcctttctttcctttttttttttttttgttttttgtttttggcccatataaaaataacatattgcaactcaaagtgcatcttttaaaataaaccatcaactatctttatcaaataaaatatttacaccatttggtttctagtgaggaaagctctttcaggctatcaccatggggacgtcatctgaaaatccagttatcataggggcatcttcatcatcttcccccaggtcatccccagaggagaagattgcggaccccagcctggagctgtagtggctgttggcgaaggcggtgaagctgctctgcagcctccggtgcttcgtgtacaggatggcaaaccccacccccaggctcagcagtatcaggaataagatgggcaccaccacagcagcaacatccgtagatctggcagcctgcgttgcagatgcatctgcaccagaccccagctcatcgtacagcaggatggcaggctccccacagatctggttgccaaaaaggcatcttgcttggacggtgaacgtgtaattatgacccatcttcaggttggaaattttaaagaaattgtcagtagtattcccaaggtaagctgtgatattcatggcactatcaaacatgtgtatctcatagcccctgctttcattaaaatgcttttcctttaaagccaggcttttccaaaacagaagaacatgatcattttctgttatgatttttaaggcatcaggtgctgataatgaaactgtggtaatttttatgctggaatctttgctcatgttccccagttggacaatgatgtggtatttcccgccaggctccaacttgttaagggtgtattccacagtgctgttacgggattttactttgtagctcctgtcagtctttcttatgagatctttgactgcaattgcatacaacaagtcctggtcaggagagtcatacggtgattcccacttgatgaccacggaggttttgcccgtatgaaccacatgcaggtgacggggtggaagcctgctgtccgggatcatcttcactacaacgtagtcagaggatggcccctggtagggtaccactacacggaccagaaacaaatactgctcatccttactgacaatgaccgtcttgttgtggagtgaagtagtcaagctcttcgggttgcgatagaggtcaagaaaggacgtggcatagaaaataccataaaccacattccgggggccggtccaggtacattccactgcagtctggttgatggctttggccttgaggctaggtgcaggtgggcgaacccctctggtcataacatgctcaaatgccagagggctatcccccaagtcagtcttggcccaggcagaaatctcataggatgtatgagctgtcagattgccaactttgtgtgacaatatgcttcctcggaagttcaaagttctcctctcttgcttgtgggtgtcaaatgcccagaaaaggttcaccacatagccattcaccttgatatcactctccatggtcagggtgaagcttagataattttcaccatagctgtcaatgtggatatctggtggtgggatcacttttccttttatggtggtaatggatttagaatcgctccagtttcctattccacgactagtcaccgcagccactctgacggtgtatagagtgttgaccaataagttcttgatttctgtaaagttactagcagccctctgggaggcccacatcttggaaccactcctgctgtattctacaatgtactcacggatgaggccatgggtgtggatgggaggagcccagtggcctacaatcacaccttctgcttccctggggagtgacagctggagatttcgaggggcatctggcaatccctctggggtcctcagggtcacaaagtcattggtgttgtgtgccttgctgagacactgaacctgtactttaacctgatacgtggtatctggtttcaagacttttaatacagtgtttgtcttattgctgtgggtctccagagtcttccatatgctctctccaaccaccctgtagtagacattatatacacaagatgcagagggcatttttttgggcctcatccaggtcaaagtcacatccccagagaagtcagctgtccactgaagattctgtactttgtacacagtcaactcatcactgcaggccttttcatcgctctcgtccgagcagtccaggaagccgtcgcagcgctccgagagcacaatgcaggcctccccgtcctcgcactggaactccctgctcatgcaagtcaaggtgctgtgtgtggggcaattggcctcgtcccggccatcctggcaatcttggtggccgtcacagcgcttccagttgggaatacacgtcttcggttggtggcattcgaactcaaatcggtcacatcgcccaagttgggtgggagtggaggcagcagtgacgtttgcaagcaaggggcaggcttcctcgtcagagccatctgcacaatctcggtacccgtcgcacacccaggtgtccatcacgcaggtcccactgctgcagcggtagtaattgggcagacacgtggagggcccaggagtcgagaagggaagaatatgtgaatctccacaatccttctcatcagaccagtccccacagtcgttctccctgtcacatttccatctgttggggatgcagtggccattctcacaccgaaactggaagtagcgggagcagtttggggcttctgtggggttttcgcagttggcttcatcagaataatcgccgcaatcatccatcccgtcgcacttccaaatcaaactgatgcacactccattctgacactggaaaccgaactcatcacataccttgtggaactcaggatcttgggagcatcctgcaaacgccgcatcctcatcggacccgtcgcggcactggatgattccgtcacagaccatggagtggaacaggcactgctggcggttcttacacacaaagtccatgaagtgcgtacagaggggctcgcagtgctgttcatcggagccatcagagcaatcacgcagaccatcacaatgtttgctggatgggatgcaagtgccgtttgggcagcggaatccattgcacttcttctcacagttgactggatcctcatcggaaccatcctggcagtccgtatccccgtcacacgcccaccgctgggggatgcagtgcccgtttcggcactggaagttggaggcctcacaggtgtgatagatggcggtacagttggcttcatcagaccagtccctgcagtcgttgtccccgtcacatacccaggaggagcggatgcacatgccggaactgcagttgtactcgtcactccggcactggtgcatttcacaatgactttcatcactgttgtctccacagtcatcctcaaggtcacatttataggacagtgggatacaagtcccagactcctggcaacgaaactgggtgtccaggtcacagatggtggtagggcagtttctctcatcgctcatgtctccacagtcgttgtcaaagtcacaccaccaaatgctgttgatacagttcccgttgctgcagcgatactggttgcgaagacaggtgttctcttctttgacacaggtattgttcttgagctgatagccctgagggcagtcacacatcaggtcccctgatggaagcacactgctggacacatcctctggacacctgcagcttctactgttgttggccttgggcaggcacagcaggctgcatggcctgggcacacaggcattgcttccagtgttcttccccttgtagaaaatcttcatgtccatgagccccgtgagctggtttgccagaatctccatctgggacccactgtatttggaagctcggaatatgctgagctgtgaccagtcatcccagtagatttcattcttaaagacagcaatggcataggggtgcgggaggttgtccagaatgacagagcgctgctggccactgaacgtgatccgctctatgcactccaggtaggcatccgtccagtaaatccactggtcgtccacagagatgccattgggccacttcacatcctcagacaccaggtgataggcagcagaaccatccatattgctccgataaatcccaggcttcaggtctccccagtctgtccagaacatcaccccctcttggggcacgaggaccagagccctgggacgatcaagcacagaggaattgacgattgtgagtcggaagtcgccatctggattagctacctcaatctttttgaagcctgcatctacccagtaaagcagctggctgaggggttcaaaagccaaagcttctactgtctccaggccagaattgatgatcacctcttgccctgtgcttccattcaaacagaggcgctggatgacgtccaaggccaggtcggaccaatacaaacagttgtgctcatagtcaaagtccagggccactgctgcccgtagcccggtgagaggcaactgctcggtggctcccgaggccaggtcatagcggtagatggatttcctcacagcatacagaatgaactcgttctcttctgccaggggacaggggaccagctctccttccagtcgcgcttcaacatctcctccgctacaagtgtccccagaaatcttccggtagcctctcgttctcctgtaagtagaacccacagggcaaggcacaggaggggagtatgactttccagaaaattccggatctggaacacaaacctctaatgacaaatcttcactcatcttgaaaccgaagtcacactcatagtcctcccgggtgcaggagcagttggacacgaccaccggcctgtcaaagtcctctccattgaagcatgtggcatggggggtccgccgtttgaaaacagtcttgtgtcccagcaaacactcattcccccgctcatcagatggtgaccacagcttgtagtcattctctgtgcagggaactcccaaggcatccgtggcattgacctggaggatcagccagctgtggacattctctttgttcgagccaaagatggtgaagacagtgctcttctccccaggttctgtgaggaggccatacacaaacactggcttctcagagaagatgaatgttttccaggtctccccttcattggtactgtattttagctcgttggtttccatgccctgggcaatggccgtgatgattccgccgtggtctccccatgtgtagtagtgaggtccaggaagtgcctctcgccacctggctccagcactgctagagatgtacacgtttgtcttgctagccaagttctttcccactgagccagtggcgatgatgaggcctggagccgactccttggacaggatgggcattctccggagctggaggttgaggagctgactgaggcgctgagccagatgaagggaacagccctgggaaagctcacaattgattttctctccatatcccgtgaaggctggagcctgaagaaactcccaggttccccctttgtcaaaggtgatgaccgatctcatgttctcctcattcatagaaccattaatcagagtagcaatgtagactccttgcaatccttccactcggtggaagtcagcaaatggttcatttgcaaaatacctcaccaaggtgtcactgccggcccctcctgggctgtaatagagcacgttctccaaggacagggagaacttcagcccctctgcctctgagatgtataaattggtgcggttgttactgtggctgacacacacaaacacctggtcctcggaggcatctgcgatgtaatattcattaataggatgtcttgtgacaaactgggctgctctcatgggcttccggccaaaggagacccagagctggacagaagactgctgttcactgcccaagagatgcaccacctttgtagcaaacatgtacttgtcccgaagctgaaaatctctcacttcctcaaggatcacttcctggttttcccgggactggaagaaatctgtacttcggaagacagtggagtagccagagggttcgtgtcgttcaatgtagatggtatttggtttgtcatagggatcaattccccaagaaaaggacttgacatgttcctgaatcatgatccaggtctggccaaagtcatctgacttccacagctgcttgttggggtgggacctgtcaaagcccaagagaaggttggaggccttactgtgtaggaggagatcagctgcccgaaatgggatggaaaagccttgaagagtgttgcagaagtcaaacgtgatccagaggtactgggcataagcgtctgcaaagatgtaccgcttgttgtccgcagggctgtggtagaactgggcgataacagcttcactcctatttcccaagccaaagtttaacttgtctgaaattttcttgaatgattttccatagtcgtaagacacgtacacatcactgctcttgggcctcgccaatgccaggctatctcgggccaaggccacgatcacgttgcttttctctccagcccagtgcaccaccatctgattgtgggaatcattcagactaacctgtccgtacaccttgatgggctcgggctgcagggcagcgctccgtttcctccggagcggcttctcgtccgcgcggctcgcccccctggcatccccgcgcgcccacagccgcagctcgcgcgggtcgccctgcaccacgaggaagccccggtcctggggcaagggcgcgctgccgccgtgcagcctctgcgtccagacttcgcagagagctccgggcggcagcagtgcgaccagggtgaataggaacgggagtcgcgactccctcctgctgctccgtgtcgccatgttcgggcgaacgctactgcaggtggcgccgccgccaggctttttgctccaggcacctgacgatttgttctgctcagtcagatgcagacaggtgtctccgaagtaccaccgctgggatatcctcgggccagcgcctaaactgaatccccacagtatcaaactcagccaggccaaagggaacacagtgacgcagcaacagggttttcatttcattttccctccccccgtttcccccaagttatttagtgctgttttaaaagtctggggccacaatgcagtctcttcccctcacaacagagtaaaagctccacagattgcgctgtctacctggtggtcagtggcagcaacagtggctgctgcttctggaaattaaacggagtcttacaacaagcaggatcttaggattgcttcaggcgtttgcgtgggggtcccagaaaagggcactgtgctgaagccagagagcggtatgcctcagccaccaagtggggatgtgacaccaccattgacttccacccagaggtctccaagacatccgaagcatgatagttgatgaaatccactgcctgagttttcaactgatctgcactgtggaggtcggccaggatgagaatttctgcagcgttctccacggacaggttactgcagagggcatcctcacacatgacctttaagcgctccagggcatacttgtcagcagctgccagcaaatcatcaggccattttggtcgaggtttggagccttccccgtgtaaatgaagcacatcatttccttaaaaacttcaggctccacatcattgatttcaactcgattctttttgctctcctccatttcatgttcaaacatggcactaaaaaccggagaacgagctgctaagatagccttgtgagcctggaattcctggccggcaacacacaagcagcagtctgtgaaccgggaattctcccacagtcctcctaactcatctgccagccggcactcaggaacctttaccatgttcatggtattctggccagaaatgttgacagaatcttgcacaacactcacctcgcagaagagggtaagcttgtcatcagggagaagcccgttggcctcatccaaaagaaaatctctacggatgaatttcttgaatccccagtctttgccttgcacaaacctatatgcccgttgactctccatagctttggtttcttctcccttggcattcaggatggagaatttgaattttgcccgaacttcactctttggacagctgaccagtaacaggtaaagtgacaggtaatctttgctttcttcatctaaccctttggggtttactcgcaaacaccatttcagtttatcatttgctcctgatgaaaatgtagaacttttaatgacttcacccatttcctcccggcaaaagctaaagttattgatggtccacatgtaggagaatttcactaccttgatctgtgtgtagcaccaactctcagctacggggccactcgacatttctgccggaggtggaggacttggaacccttgacatcgccagtttgaaggttaaacgagatttccaaagtcagggggcaaagatttctgttccctcttcaccctgagagcggcggcgacagctgctggtccccgtccccctgcgcttgcctcatactgtccgcaacatccgggacctgcgggaccggaccgccgatacacaaatacacacacactcggagcgcgcacactcacacacacacatacacaccgacacacaccagccgg

SEQ ID NO: 4324 - DNA, 603 bp, Homo sapiens
  misc_feature (1)...(603): n = A,T,C or G
cggcactcaggaacctttcccatgttcaggtaatctgccnagaaagtttgacagaatcttgcacaacactcacctcgcagaagagggtaacttgtcatcaggatggagaatttgaaatttgcccgaacttcactctttggaacagctgaccagtaacaggtaaagtgaacaggtaaatctttgctttcttcatcctaaacctttggggtttactcgcaaacaccatttcagtttatcatttgctcctgatgaaaatgtagaacttttaatgacttcacccatttctcccggcaaaagctaaagttattgatggtccacatgtaggagaatttcactaccttgatctgtgtgtagcaccaactctcagctacggggccactcgacatttctgccggaggtggaggacttggaacccttgacatcgccagtttgaaggttaaacgagatttccaaagtcagggggcaaagatttctgttccctcttcaccctgagagcggcggcgacagctgctgtccccgtccccctgcgcttgcctcatactgtccgcaacatcccgggacctnggnccgccngatacacaaatacacacacactcgnncgcg

SEQ ID NO: 4325 - DNA, 585 bp, Homo sapiens
tgttttttgtttttggcccatataaaaataacatattgcaactcaaagtgcatcttttaaaataaaccatcaactatctttatcaaataaaatatttacaccatttggtttctagtgaggaaagctctttcaggctatcaccatggggacgtcatctgaaaatccagttatcataggggcatcttcatcatcttcccctagagacaaaacagtcaggccttggtgagttccaacacattttcacctgaccccatatcccaccactctacccacccctcaaccctaccacaaccctctagctgagaaggtcaatgccatagccaggcagccaccataatcagctgtgaaacctagcccagcttcccactgtccctcctggccaccttctacccatcgatggatcctcacatttattttagtggtcgtttgaacgtagccaaattaggaaaacaaagcttctcaggagaagactcttattacctactcaaaagctaagtgggtagtttgggttccccagtttgagttatctataccctacactagcacagtgaacttcagtgtctgctttctcttctgaacccaaag

SEQ ID NO: 4326 - DNA, 588 bp, Homo sapiens
  misc_feature (1)...(588): n = A,T,C or G
ccagctcgnctntagctagngngtgtcagatnaccagtaaaaggttcaccacatagccattcaccttgtatatcactctccatggtcagggtgaagcttagataattttcaccatagctgtcaatgtggatatctggtggtgggatcactttnccttttatggtggtaatggatttagaatcgctccagtttcctattccacgactagtcaccgcagccactctgacggtgtntagagtgttgaccaataagttcttgatttctgtaaagttactagcagccctctgggaggcccacatcttggaaccactcctgctgtattctacaatgtactcacggatgaggncatgggtgtggatgggaggaggaacttnggaacttccgagggaagcatattgncnacacaangtnggnaatcttgacagctcaatacaatccttttgagatttcttgcctgggccaagattgatttgggggnttncccccctggaattnggnnattttatgacccggggggntccccccccctcaacntggcccaagggccaaggcancaaccngnttgagggnggntccantgggnttanc

SEQ ID NO: 4327 - DNA, 482 bp, Homo sapiens
tttactcactccaagtcaccagctttattacagatcgacagtttttattagagcccagattgccaaatcaattcagtttcagccatgtgacgtttatttataaatctcttgtaacgagtggtacttctggggtggttaaaaaaatattatgtatataatattaatcctatatatctaatatctacctgtgtatggaaatatgttttctctgtcatctaagccccatcaacttagatgggcatcaccaatcatgggtggccctcgccctagaccttaggccctcagcctgggaagagccaaccaggcttctgagtaatggtaagtgcttaacgtccaatccagaagactcacggcagtttctctcatcgctcatgtctccacagtcgttgtcaaagtcacaccaccaaatgctgttgatacagttcccgttgctgcagcgatactggttgcgaagacaggtgttctctacccatcagagtgcg

SEQ ID NO: 4328 - DNA, 454 bp, Homo sapiens
  misc_feature (1)...(454): n = A,T,C or G
gtttactcgcaaacaccatttcagtttatcatttgctcctgatgaaaatgtagaacttttaatgacttcacccatttctcccggcaaaagctaaagttattgatggtccacatgtaggagaatttcactaccttgatctgtgtgtagcaccaactctcagctacggggccactcgacatttctgccggaggtggaggacttggaacccttgacatcgccagtttgaaggttaaacgagatttccaaagtcagggggcaaagatttctgttccctcttcacccaagttaagtcagtaggaaaactctaatttgtcttgtctaacaggaaatctctagagtagtgaaattcctagagacagaaagtagaagggtggttcccagagcctgagagcggcggcgacagctgctggtccccgtccccatgcgcttgcctccatgactntactgcacgagg

SEQ ID NO: 4329 - DNA, 531 bp, Homo sapiens
agttttccaactgatctggcactgtggaggtcgggcccaggatgagaatttcctggcagcgttctcccacggacaggttaactgcagagggcatccctcacacatgaccctttaagcgctcccagggcatactgtaaaacacaagcactgctgtcatcagagcagcaatagttctgggctgaccactactgaagctgttttctttagctgtaccatcatattaactagatacttgaatagaactgcacagaccatgaaaagctactactgcaatgataaaacataaccatttctgaaggttagatgtttaagcttgaaatgtaaacagctaaagtaacttggaaagctgccattagagttctaaagtctacctattagaaaaatggcaattacagggtagatctgcatcctgaagtttactctcctcctgactgtgatgaaagttgttcttaaaccttcaccacttacaattacagtgaggcatcagtctgcttcacgtcaacagggcaactcaatggtctatcataattc

SEQ ID NO: 4330 - DNA, 398 bp, Homo sapiens
ggggtttggagactgcgtcagccattctttattgcgctctaaagaacagctcgagacacacagagacagtggattttcaaagaggtgttttcttgacccagttaaatttttattcagtgaaaaaagttgacattgagacaaaaattatcttaaagttgtgcaacaatacagtaaaaccttcagcagatttcagtgacttggaaacttatcgaggcaattgaaattataaatacttaatttcgctttggagagaaacaagtatacagtgtttcacttcaaataagagtagaataggcctttattttgccgcaaatacttttgattttgcctaaagtttctaatagttcataacaagagtctttaaatgagaagtgacatagaatatttgaggataatgg

SEQ ID NO: 4331 - DNA, 433 bp, Homo sapiens
ttttttcttgacttagttaaatttttattcagggaaaaaaggtgacattgagacaaaaattattccatatctcagtcttgcatagaaagtagtctatataaacttaatgcactggcttttattacacaaaaattgtacctgaaaggcagcacacactccagttaagaaaaataacacaacaggaatgtcaagatacaatcccaacacaagattctgcacagagttttagagtcaattcctaaaatcaatatgggatgatattcagtttagttatgtctctggatgccttctctaagggactcatccaactgtctgcagaaggaagaaaattttcaggaattccccatgactcccttcatgaagaagggactgaccaaacctgataggatggtgtttctgccctaaggaagtgtactggaaatataatcttact

SEQ ID NO: 4332 - DNA, 358 bp, Homo sapiens
  misc_feature (1)...(358): n = A,T,C or G
agnaaacccccctgcccaacccaatttttaagagncccatccctggtcccacatggatgcaagcatctgacattctaatgtatnccaggagagaataaaacctttttcctgcacagtgtgaacttctgaggtggcatctccaacaaggtacaaaagccccttcttcacaagcaagcagggactccgattggtcacagtgaagacagttatgtggtcaccttcagaggctgcaccatttggtttctagtgaggaaagctctttcaggctatcaccatggggacgtcatctgaaaatccagttatcataggggcatcttcatcatcttcccccaggtcatccccagaggagaagattgcc

SEQ ID NO: 4333 - DNA, 344 bp, Homo sapiens
ccaatgagtttttattagcaggtaagtcatgatttaggatcctggggtggggatcactgggtaccaggtcccccttcaccatcctgggagaaggatggaggacagaggaaagggagatgcagccagttcagatcttcccgggaattacttgtccaaaagtcagagtttcaaccagttacccagaatgataactatttacccagcttgtcaaggtagccagtagttcctggagcttctcacctgtctggaactaggactgcacagacatggcctcttcctggaatcctctgtagaactccactctctaacattttatccatgtggactcgtatctcataaagctc

SEQ ID NO: 4334 - DNA, 331 bp, Homo sapiens
  misc_feature (1)...(331): n = A,T,C or G
tggtcccacatgtaggagaatttcactaccttgatctgtgtgtagcaccaactctcagctacggggccactcgacatttctgccggagatggaggacttggaacccttgacatcgccagtttgaaggttaaacgagatttccaaagtcagggggcaaagatttctgttccctcttcaccctagagtagtgaaattcctagagacanaaagtagaagggtggttcccagagcctgagagcggcggcgacagctgctggtccccgtccccctgngcttacctcatactgtccgcaacatccgggaactgcgggaccggcgatacacaaataca

SEQ ID NO: 4335 - DNA, 303 bp, Homo sapiens
aggacctctctcagtcaatacctccctttgcctcactgtcatttcatagaggataaaggatgtatctgtcttgcaacatgagtgctaacaacagagagctctctgatgcttgtatggtggtaaggagtttcacaaatatccgagttttagcacagttagaggactaaaatgtgtgtctctcaatataaatactactggaatccacaaactgattttgagaaattctgcaaaaatctttatggtgttgaaaactggaaaaaataactcatccacaatatctaaaaacagagaaccatagttctt

SEQ ID NO: 4336 - DNA, 300 bp, Homo sapiens
  misc_feature (1)...(300): n = A,T,C or G
agaagaggaattgacgattgtaagtcggaagtcgccatctggattagctacctcaatctttttgaagcctgcatctacccagtaaagcagctggctgaggggttcaaaagccaaagcttctactgtctccaggccagaattgatgatcacctctcgccctgtgcttccatncaaacagaggcgctggatgacgnccaaggccaggncggacaatctcggccgaattctgcagcccgggggatccactagttctagagcgccgcaccgggtggagctccagcttttgtcccttagtagggt

SEQ ID NO: 4337 - DNA, 1307 bp, Homo sapiens
taccgggccccccctttttttttttttttttttttttttttttcagcaaaataattttatttcctaacatatggtaacatatacatccaatatgtgctccccttgcacatctattcacaagtgacttccaaatgacaactgctttgatatttaagcatgtgctaaaagttatcttagttgagatatgaaaaatgctttagatggataacattctgagtatattggattagtcacagcagaatttactttagttagatgagttctacaaatttaaagctttgaaaagctactacttttacttctaatacatccagatgaacacgatgtagcaatatcagcttgtattccagagaaatctcattagtttttctggtgatggaaccacttatccacgtctgttggtactgtgcaggcagattcacagggtggtggtaaagcatccacaatggctctggcagcatcaggatcacacttgaaggggctctcagacaaagttgtattcatgcaactgattccttttccattcgttttcttagtcactaatgctttccaatggtcatgagtgcttttaataatatcaatggcaaagtccttatctttaaattctgcattaaacgcaaactcattttctggttttccatcaggaaccttataccttctaaaccagtccacagtagcttctaagtagccaggtttcagccgtttgacatcattgatatcattataattggctgcatcaggatcatccacattaatggcaatgactttccagtcggtttccccttcgtcaatcatagccaatatgcctagaactttcacgccaattatttcacctcttgcacataccttgcttccaatttcacacacatcaattgggtcattgtcaccacaacagccagtatgtttatcattgtgccctgggtcttcccaagtctgagggatggcaccatagttccagatatatcctttatacgggaacaaattcgcaacatagcgaagttttccttttttcacatcttgtttaatagggtttaaagggtcctttgtagcaatctccatttttgcattagaccagcgtggtacttcaactaccatgtgaaacacatccttatctgcataaattggaatatcatgaaatggagatatatattgtcctttctcatttttgaggaagactcggtactccagggagaagggcgcggcgcgctcctcggtgctgaagccgctcatagtgccggagtcctgccgccgccgctgccacagagccaccagcccgcacgcggcgccgactgacaaggagagagccc

SEQ ID NO: 4338 - DNA, 893 bp, Homo sapiens
  misc_feature (1)...(893): n = A,T,C or G
tttcagcattttttttttatttccttccagacgcacctacttcatccaatatagactacccttacacgtatattcngcaaataacttgcaaattacccctccttnnnnntttaancntgtcctnnnntttatcttagttgagatatgaaaaatgctttagatggataacattctgantatattggattagtcacagcagaatttactttagttagatgagttctacaaatttaaacctttgaaaagctactacttttacttctaatacctccanatgaacacgatgtagcaatatcagcttgtattccagagaaatctcattagtttttctggtgatggaaccacttatccacgtctgttggtactgtgcaggcagattcacagggtggtggtaaagcatccacaatggctctggcagcatcaggatcacacttgaaggggcctctagggacaaaggtggtattccaggcaaccgganccctttccccatcgtttcccttagtcacctaaggcttcccaaagggtcatgantgcttttaataaatatcaatggccaaagnccttatctttaaattctgcatnaaacgcaaactcattttctggttttcccatccaggaaccttataccttctaaaccagtccacagtagcttctaagtagcccaggtttcagccgtttgacatcattgatatctaagaagagaagaagcataagatgacagtgagaatgatttttttaaaaagaaagaagagaataagcagatttcaagatgcacaaataattatacactcaacaaaaattccaagtacttattttgaaagagctgtggaatgacttatcacggaagttcaagataacattggagcgaagccccttgttgagaagagaagcca

SEQ ID NO: 4339 - DNA, 438 bp, Homo sapiens
  misc_feature (1)...(438): n = A,T,C or G
nnacatttggggntccttcccccnaaagttntggaaggggaatgggncaacccataagttncccagganataacccttttaatacgggaaaaaaattncgcaacatagcgaagttttccttttttcacatcttgtttaatagggtttaaagggtcctttgtagcaatctccanttttgcattagaccagcgtggtacttcaactaccatgtgaaanacatccttatctgcataaattggaatatcatgaaatggagatatatattgtcctttctcatttttgaggaagactcggtactccagggagaaaggncgcggcgcgctcctcggtgctgaagccgctcatagtgccggagtcctgccgccgccgctgccacagagccaccagccctcgtgccgaattcctgcagnccgggggatccactagttctagngcggc

SEQ ID NO: 4340 - DNA, 282 bp, Homo sapiens
  misc_feature (1)...(282): n = A,T,C or G
agaccagcgtggtacttcaactaccatgtgaaacacatccttatctgcataaattggaatatcatgaaatggagatatatattgtcctttctcattttctttgattctcacacactcctccccgnagtcctattccttatctcaaaaggcgttgataagtcacctgcttccccagacaggctctgcttgcggtcttaaaggtgagcatttttctgatccgtcgtaacaaagttgagccatattactgacacccctagtggctactagtaaggtactcgcttc

SEQ ID NO: 4341 - DNA, 425 bp, Homo sapiens
ttttttttttttttttttttttttttaggaaagatggggtttcgccatgttgcctaggctggtcttgaactcctggcctcaagtgatccgcctgccttggcctaccaaagggctgggattacaggggtgaaccactactctgggcttgccttggtattttaacaatcggaattgtctttggggcaaatgctgatttcatgccagccgtggttctgggtgctttgattaggatattgcatcccatcttcccaacaatcttatttattggtgagaccactaaggcttcgagaggttaagcaacttttacttccaacactggcccgcccaccccttccgccgcgcaccccacacacatgggtagtaagtagtggagatgggatttgaagctggggattctggctcaaaatccaagctctttacctttg

SEQ ID NO: 4342 - DNA, 418 bp, Homo sapiens
  misc_feature (1)...(418): n = A,T,C or G
gggtccacgtggagtcggcgatgcgcgcgggaaggctgacagcgcccccataactgcacgccccccatgtccagcaaccaagggtaacgccagcctccgagacccaaacgatgtctgtgcaggctgtgctagnatcgatgcggcccctgcccgggcctgggctggaggcagaggggtcccatgggagagcacaggctgaaagagggttctagaatggggtcaggtggagtctgcacactggggcgtttatttctgagacgcccaagcagccccaggggagatgaccagctctgggcggtgtcggggaggctgagtccagtccagggctctgcacacggagggtcccggcagcnngagtttggcattcctgcacacggagggtcccggcagaggnagtttggcattcctgcacacggag

SEQ ID NO: 4343 - DNA, 486 bp, Homo sapiens
ctatttgctacagagctagaacctttattactttttaaaaataatttcaacttttattttagattcatagggtatatgtacagttttgttatataagaatatgggcaatgccaaggtttggggtatgattgatcacatcagctggttactgagcaagctacctaatagttagttttacaacccttgccccctttttaggagtccccattgtctattattgccaactgtatctccatgaatatacacttataagtgacagcaaacatgcagtatttcgttttctacaatatgaggctacagtaaccaaaacagcatgattctagtgcaaaaacagatacatagaccaatggaaccgaatagagaacccagaaataaagccacacgcctacaggcaactggtctttgacaaagttggcaaaagtaagcgatgaggaaagaactccccattcagtaaatgatgctgggatacctggctagctatatgca

SEQ ID NO: 4344 - DNA, 2665 bp, Homo sapiens
ctgcaggatttgtttatttcacactcacccttgaggcccggcccgcgcccgtgccctccctctccctgcgccggggccgcggagctgcagggccaaagcaggaggcagaaggctggacttagtaagtggtgaggatggtgagagaaatattcagcagtcagactggaaaggacttgtctgcaagctgggtgtggagtatcagcatcaatcctaggtttttctgcctggttaggtggggaagcagatttgagagaaagaccttagtttggataaacggggtctgaactcgcctcggatttgccgggggtggagctcaggacgtcctggttggggagggcattcagagagtagatgccagtcctgggaaaggcaggggaggagaggagagccacggctgacgcttggggacagaaggaggagcctgaggaggagacaggacagagcgtctggagaggcaggaggacaccgagttccccgtgttggcctccaggtcctgtgcttgcggagccgtccggcggctgggatcgaggtgaacttaaaccccagcctgggtgttcactgggggcattgagggagtggtcagaggcggcgagggcagcggggagggcaaccccccattacttctctcccctttccccatgcagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggtgagcgcgcggggcggggcctagggcagagcagggacggggctggggcaacaaaaggcccggggagggcagggttgtcgtctccgctagaagtaggcgagtgtgaaaccgcacaggggtaaattgagcctcagtcactcccacttccgccccaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaaggtgtgagtccgcccaaaccctgagccggcttggcgggagggcatggcctgggaagcggatgccggaccccacctctttgaccactgttcccgtcatctctagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgtttctgagttttacagatgggaaaactaaggccaaaggataggagtggggttcacacagctaagtctgaagggaaactggaagcagcaaccacctctgcacctcacctggtctaagaggggttcaggacttgggccaccaaactctagggcctgtccctcaggtgcaattgcagctgctcctaggctatgccaacctctgccagagagcagctgtgagggtgtgagcaaagacaggaacagcagaggccagtggagggagtggggaacagggccaagggagctcttgggcttgactctcaaggcctgaatcagtgtgtgtgtgtgtgtgtgtgtgtgtgtgtgtgtgtgtgtgtgtaatgggagtggggctgggaaaattggtgccttccaagaaggagtgtcctgtccaaccccccgcacccccacggaaccttcaggag

SEQ ID NO: 4345 - DNA, 1736 bp, Homo sapiens
agcctgaggaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccaaaaaaaaaaaaaaaaaaaaaaaaaaaaaaaaaaaaaaaaattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaaaaaaaaaaaaaaaaaaaaaaaaaaggccaaaggataggagtggggttcacacagctaagtctgaagggaaactggaagtagaccatataaatatggaataaatacatgaccagtgagagaggcaaaatgtcggaaagcagaccccaggccagctgggtctctactaccaggaccccaggctcaggccatcaatcaccccaggagaagggagcccgacccccaccaggacccagtgagaggtagacagcacaaatgctgaaggagcaccaa

SEQ ID NO: 4346 - DNA, 1004 bp, Homo sapiens
  misc_feature (1)...(1004): n = A,T,C or G
aggcaggcctcatcccaaccttgacacatgctctgtaggttgaacacataatcacaaatattctagcaaatgctgccttggttgcagcctccactgtagacccaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatctttgtcattactgttttaattgcctggcttctctctggactgggagctcattgaggattctgaccagtgacttacacaaaaggcgctctatacatattataatatattcgcttactaaatgaataaggactttccaactgcgtttctgagttttacagagctgtcactgttggagtctaggtccgtgtcctcccacaatcccctgaactccccgaaggcaggaatggggtctgattcacccccgtgtaccaagcacccagcactgggtgcataatgaatgaaggatggatgggggaggagccccccactattaaggcggggtctagtgacaaatgagagggtgtggcctgtgcggagagaagccccggagaggacaaggtgaagagccaatggggaaccagaaatagaggaggggcgtgacctgcagccaataagtggtgggggataaggtgaagggcgtgcccaatggagggtggggccaggagacaatggagtggaggcttctccgggagatcaggaaaggtcgcgtcgcgcgcctcctcccggcctttgggggggtccgtccgcgtgccgtgcccccacctgttagctcctcagctcgccgcccangcgtcaccgtctgctacaccggccaccggaccccagccgcgggaacagtcgccgatgcgtacgt

SEQ ID NO: 4347 - DNA, 688 bp, Homo sapiens
atcagaaagatatgaaggactgggttgaagccctgaaccaagccagcaagatcaccgttcccaaaggtgggggcctacccatgaccactgaagttctcaagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgtttctgagttttacagatgggaaaactaaggccaaaggataggagtggggttcacacagctaagtctgaagggaaactggaagcagcaaccacctgcacccccacggaaccttcaggagctgctgctcccagccacaggaagtagaccatataaatatggaataaatacatgaccagtgagagaggcaaaatgtcggaaagcagaccccaggccagctgggtctctactaccaggaccccaggctcaggccatcaatcaccccaggagaagggagcccgacccccaccaggacccagtgagaggtagacagcacaaatgctgaaggagcaccaaggggccaggtaagggaagggagagactggagtact

SEQ ID NO: 4348 - DNA, 464 bp, Homo sapiens
tttttttgtcattactgttttaattgtctggcttctctctggactgggagctcagtgaggattctgaccagtgacttacacaaaaggcgctctatacatattataatatattcgcttactaaatgaataaggactttccaactgcgtttctgagttttacagatgggaaaactaaggccaaaggataggaagtagaccatataaatatggaataaatacatgaccagtgagagaggcaaaatgtcggaaagcagaccccaggccagctgggtctctactaccaggaccccaggctcaggccatcaatcaccccaggagaagggagcccgacccccaccaggacccagtgagaggtagacagcacaaatgctgaaggagcaccaaggggccaggtaagggaagggagagactggagtactgggacaaccaaagccatctcatgcaagaacaagtttctattccca

SEQ ID NO: 4349 - DNA, 423 bp, Homo sapiens
gtcattactgttttaattgtctggcttctctctggactgggagctcagtgaggattctgaccagtgacttacacaaaaggcgctctatacatattataatatattcgcttactaaatgaataaggactttccaactgcgtttctgagttttacagatgggaaaactaaggccaaaggataggagtggggttcacacagctaagtctgaagggaaactggagcaaactcttaaccattcttcaaggctcagtttaggcctcacttcctccaggaagccttccccgcgtctagtgtcccactgcttcggcgacttctttactcagagctgtcactgttggagtctaggtccgtgtcctcccacaatcccctgaactccccgaaggcaggaatggggtctgattcacccccgtgtaccaagcaccc

SEQ ID NO: 4350 - DNA, 422 bp, Homo sapiens
  misc_feature (1)...(422): n = A,T,C or G
cccttttaaagaggcttnaaaccgggagcccggagcccagaacccagagctggaaccccgaggctgaagcagaaccagagccggaactggagccagaaccggacccagagcccgagcccgacttcgaggaaagggacgagtccgaagattcctgaaggccagagctctggaccaggcggtgccccgcccatgctggataggacctgggatgctgctggagctgaatcggatgccaccaaggctcggtccagcccagtaccgctggaagtgaataaactccggacggtccggacgggacctgggctctctccacagattctggcttgtttgcccaaggaacttagggtgggtacctctgagtcccagggacctgggcaggcccaaagcccaccacgagcatcatccagtcctcagccctaatc

SEQ ID NO: 4351 - DNA, 379 bp, Homo sapiens
tcattgtcattactggtttaattgtctggcttctctctggactgggagctcagtgaggattctgaccagtgacttacacaaaaggcgctctatacatattataatatattcgcttactaaatgaataaggactttccaactgcgtttctgagttttacagatgggaaaactaaggccaaaggataggagtggggttcacacagctaagtctgaagggaaactggaagtagaccatataaatatggaataaatacatgaccagtgagagaggcaaaatgtcggaaagcagaccccaggccagctggtgtctctactaccaggaccccaggctcaggccatcaatcaccccaggagaagggagcccgacccccaccaggac

SEQ ID NO: 4352 - DNA, 281 bp, Homo sapiens
  misc_feature (1)...(281): n = A,T,C or G
ttaaggagcttgaaccggaacccgtacccagagccagagntggaacccgagctgaagcagaaccagagccggaactggagccagaaccggacccagagcccgagcccgacttcgaggaaagggacgagtccgaagattcctgaaggccagagctcttgaccaggtgccccgcccatgctggataggacctgggatgctgctggagctgaatcggatgccaccaaggctcggtccagcccagtaccgctggaagtgaataaactccggagggtcggacggga

SEQ ID NO: 4353 - DNA, 2924 bp, Homo sapiens
tgtcagactggctcgcaggcggcgcggccgcggaacccgttcgagacagcgcgggcggctcgggtcccctggggctccgcagcaggaggacgcctatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacactaaaaaaaaaaaaaaaaaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttatatatatatatatatatatatatatatatatatatatatatatataatatgtacatatgtctatatgtgacccatcatgataaatactgacatctattatttacactcaaataattttacattttcttctgttagactactccaagactggaattgttttgttttggtgtttttaatgagagggtctcgctgtgttcccaggctggtcttgaactcctgggctcaagtgatcctcctgcctcagcctcccaaagtgctgggattataggcagggaggccacccgcaccccggcccaagacctggaatggtttttaggtaaaaatattcctgaaagtgtggaaatccttcatttcctccctccatctgaaaggacagctttccagagacatcattccttttccagatgtctcctgacagttgtgatctttcgttaaaagcaaactggagccatcccaccaagttagggaacagctatgtcccttgtggggttcatctgtggcactgggaattaagcagtcatcttccaaatctgagatccctaaatccactgtcttgattgttcttttgccagttgtcaacaagcccttctcaaattcttcctcagttattttgcctttcttaagttttttcaagagtcttgtgtcattaagaagttcttccatgtcctcatcttcaatatcagaaccctcttcccttttccttttctcattcatttttttcttcttttcttttttggccttctgctttgaccaagctttattttttatgaattttcttctcc

SEQ ID NO: 4354 - DNA, 700 bp, Homo sapiens
tgtaaaaagatcatgattgagcggggagaactttttctcgggagaatatcactgtcaagaaacaaaattgcagatctgtgcagtactttcatcaaagatgtagcgacaatattgactcacgcctactccagagtggtcctgagagtcctggaagcagcgtggcggccaagaagcgatttagtgtatacgtcacagagtcacagcctgatttgtcaggtaagaaaattgccaaagccctctgccacctcaacgtccctgtcactgtggtgctagatgctgctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgccgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaaga

SEQ ID NO: 4355 - DNA, 533 bp, Homo sapiens
  misc_feature (1)...(533): n = A,T,C or G
aaagatggagcgacaatattgactcacgcctactccagagtggtcctgagagtcctggaagcagccgtgggcccanagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcaaggaacaaacctttctatgtggttgcagaaagtttcaagtttgtccggctcttttccactaaaccagncaagacgttcccaggttaagttttaagtattaagggcagacactcttcaaggttcgcgncagantgggaccaagacctcaaagaggagncttccntggggttcgattacattgccccnttccttaattcattntggttgtttacagacccggggcgttt

SEQ ID NO: 4356 - DNA, 466 bp, Homo sapiens
tttttatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttttatatatatatatatatatatatatataatatgtacatatgtctatatgtgacccatcatgataaatactgacatctattatttacactcaaataattttacattttcttctgttagactactccaagactggaattgttttgttttgttgt

SEQ ID NO: 4357 - DNA, 446 bp, Homo sapiens
gtcagcgatgagctcatcaagctctatctgtaacctgtgagccctttcctgccaaggtgcagcttacgtagttgaggcaggactgatctgcctaaagcacgcgagatgcaggcgaaaagcagccatacccctctgccacaaacgaccaacagctggtcaggacgttacacgcggtgccttgtaagaggcaagaaacacttgccgaatctgcgtctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaactcgtgcc

SEQ ID NO: 4358 - DNA, 480 bp, Homo sapiens
  misc_feature (1)...(480): n = A,T,C or G
atccnaccctgtcttnaaccctccccctgnaactcccagantgaatcctgccctaaaagcacctcgaaaattgccggccgaaaangcagccaaaaccccctcggcccacaaatgncccaacagnctggtcaggacgttnacacgcggtgccttgtaagaggcaagaaacacttgcccgaatctgcanctggcttccagtggtaagcacattcctcagcaggatcaagccaaacagtaaaanctcccaagagaacncgaggaaggcagaaacgatgtttagcaacagtattctgcatggttcnctgcttaagaaaatgccttctggaatatttgtaaactgaaattctgtatgtgtaagagntgtttaaatatgtttgggncctaaacagctttttaaaattatacttgggaataaattcagcatcttttcaaataaactctatgaaagacgctaaaaaaaaaaaaaaaaaaaaaaaaaaa

SEQ ID NO: 4359 - DNA, 451 bp, Homo sapiens
  misc_feature (1)...(451): n = A,T,C or G
cctgcacntccccagactggatcctgcccctaaagcnaccgccgagatggccagggcgaaaagcnaggcccacacncccctctggcccacaaatgnccccaaccagcctgggtccagggaccgttaccaccgcggtgcccttgtaagagggcaagaaacacttgcccgaatcctgcatcctggcttcccagtggtaagcacattccctcagcaggatcaagccaaacagtaaaaactacccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagattttaaa

SEQ ID NO: 4360 - DNA, 682 bp, Homo sapiens
  misc_feature (1)...(682): n = A,T,C or G
aaagcaaaaactcccctccctttttcccctggaatttaacaacctccttacccnaggagtcctaagnagtaatagtttcccaaaaaaatacttctttcctaaaagaactcaaaattccttgtttcccttagtcccaaagtattgggatctgccccttaaccccattagtattaatgtgagtttcaagcaaacatccactgtccacattaggtgacatacatcactgtggtactgtcttgtactttctctaacgttctcaaaatgtcatcttcagtaagaaaatggccaaagccctctgccacctcaacgtccctgtcactgtggtgctagatgctgctgtcgggtgagtgcccatcttccccagccataatcacctcccccaccccatgctggcttacagcaagttttcagattgaaagtttgagtcccgttcataaagccacaccaggtagcgtcctacttcttaattaatagctgccctaaaccagcaagcttgttatgacggttgtgatagcatacaaagaagacagagctgtaggatgttggggagagtgggagttgtgtctatagctttatggctgtaagtgttgagtttgttgttgttgttgtttttgtttgtttgttttttgtttttttgggatggagtccagcctgggcgatggtgagaccctgtctcagtaaa

SEQ ID NO: 4361 - DNA, 370 bp, Homo sapiens
ggggccgctccaacatcagaatggtaacctggggcgtggctggacaccctcaggagtaagcgatgaagtaatcaagctctatctgtaactggtgagccctttcctgcaaaggtgaagctaacgatattaaggaagggtgatatagggctgacacaccagtgagtcagggccaaactgagatgtgtttaatgaagatttatggagtaaggacttaaaatcatacatcttggagaagctttcttactcatttcagtcccatctaaaaatgtgtcagctattctaaatcccaacttaaattgttcttacggtttctagaaactttccttttcagtttccagaaatacaagttagataattggctacttaactg

SEQ ID NO: 4362 - DNA, 1085 bp, Homo sapiens
  misc_feature (1)...(1085): n = A,T,C or G
aacccacttactatttgaacttattttaaaccgtggtccaaaaaccttaaataangctccccaagcccaaagccaaaaccacaattccacgtgcccttcctgcctcctacataactgtgaaaatccctccttccatgtcccattccccatggaccagccttacattgaatgggtacccactaagaaaagataccagtttaaactcacatagcttaagtgattatgcatcagaagtcagtaccttatattgacccagaaataagaaatattcttttatttaataattgagtcatctgaagagaaaagtgtactctggtaaattctggtatttatttataagtcaatgctaactctgatgtggcatatccaacaatatcttttcaatgaagacaatatacaccaaatgtaatccatttaaactccaactaattcaaaatgcttaaactgtttaggttaatcaaatactccaggtaacaaagctattatatgtgacatatcaggatcacaaataatttcagaacatgcatactgtaagatacacacaaaactaaactatactgaacgtgaggtaatcttgccatgataattaaggaaacattcatgatctcttataatactccagtgccaacattatgaaatgtatattttggttaaaaataacaactttgtggttatctgtatactgagtaaatatatgttgaccatacacttccctaaaagaatgtatctagagtaactacataatcaaagaagaaactttttcaggcccattacatgtgactatataaaagtgaaccattttatatgcagttaatttgatttttttttagcaaactataacacattttaaacttctgacttattagcaaaacaattttaagaggcaaactctgtcacactactcaaaagctgcaaaactctatgcacagtccatcaaacttcactggttttggttaatgtacatacaaagtaatcacatttttactgccatatcacaaacactcaaatatttgctgtatggattagccaatgaatggagactcatcttttaaaaacaaattacgtttttaaaaaaataattattt

SEQ ID NO: 4363 - DNA, 766 bp, Homo sapiens
  misc_feature (1)...(766): n = A,T,C or G
ttttttttttttttttttttttttttggaaaggaaaactttatttcttgagaagggttgcaaactgcaggctgggaagtggcacctccagctgagaccacaaacaggtactttgagggagatagggtgggataggagttttatgccaaacaggttggctaaacagacatattcaacaggtcacagggggaactatgaatattcatgaaagggggtcatatgtgtgcttgataagcaaacatatgtgttacatacatcccatgttcaccttcgagtggagaattaacattaaaatgcagtaaaattaggttctgtatgttaaaaggtgaaacacaggacacgaagacactttgtacacagcctcggtgaaccagccagaaccagcccatggttgaatactttgtagcctagtcagtttgtcacttcaaaactgcaaaaagggctgggagtcaggccgcatcagcaggcagttggttgaagtcagcggaggggtgttccattctttgtttttccagggcttgtttaagtctctctttcctccccacagtggactttctcaaactggggtattgacctctgatgaaccgccatgcaaacccgtgcctttcaacataaaaagaagcccttcgaggtgctcaccttcaagcttgtcaaggaggagccaagatgcccgaataggaacagctcctgtctacagctccggtctacagntcccagcgtgagcgacgcagaagacgggtgatttctgcatttccagctgaggtacc

SEQ ID NO: 4364 - DNA, 445 bp, Homo sapiens
  misc_feature (1)...(445): n = A,T,C or G
tttaagagacatagtcctgctctgttgccaaggctagactgcagtggtgtgatcataggtcactgttaacttcaaattcctgggctcaaccaattctcccacctcagcctcctgagtagtaactatgactagaagtatgcagcatcatgtttgactaatttattttttatttttttagagacagggtcttgctatgttgcccaggctggtcttgaatttctcaagtgatcttcctgctttggctaattccgtatttcttactcctaaattctacttttatataaaaaacttacaaatttaagtagtgttttttgaataatgactcttcataggaatagggattttgcatactaaaaagcatcatactagctccactcctttcagatatgattgctttctaaagaataatnctgaatgtgtatctcaagacatataaattttgagg

SEQ ID NO: 4365 - DNA, 356 bp, Homo sapiens
  misc_feature (1)...(356): n = A,T,C or G
aggtcactgttaacttcaaattcctgggctcaaccaattctcccacctcagcctcctgagtagtaactatgactagaagtatgcagcatcatgtttgactaatttattttttatttttttagagacagggtcttgctatgttgcccaggctggtcttgaatttctcaagtgatcttcctgctttggctaattccgtatttcttactcctanattctacttttatataaaaaactacaaatttaagtagtgttttttgaataatgactcttcataggaatagggattttggctccactcctttcagatatgattgctttctanagaataatctgaatagtgtatctcaagacatata

SEQ ID NO: 4366 - DNA, 468 bp, Homo sapiens
  misc_feature (1)...(468): n = A,T,C or G
acaaggttttttttctcctttgagattataatgaacatggtcacaccacaagtaaagtcagaagtaggacagagaacgctccgaaggctggtttggtcatccgagatcattaaaaatggctgaccctaacaatatataccaaaaaaaaaaaaaaaaaaaaaaaaaaaaaaaaaaaaaaaaagggcggccctctctactcgaaggtgaccacgtttagattctgagacgggaagtggagggtgaataggtcacggcggcctttttttttttagtttaacttttccttttttggctgctagncaatccctcgcggccttctgcttcttggtatcgacatcgncatcctcatcatcttcagctgcccgcttgcccgtagctgactcagcttcctcattttcatctccatcctcttcctcaccatcaccttctttttcctcctccttttcctccccaccttcttcccttttc

SEQ ID NO: 4367 - DNA, 579 bp, Homo sapiens
gaacaactcagcaaaataaaattcctgtttattgttggacaacattgtttcacacatacatcaaacaggccaaaaaaaataaacagcaacttcatagacaaaaaaggaaaaaaaaagaaaccttttatctttggcctttttaaccatctcatacaaaccaactacttatagtacagctaagtacatacacaaaaaagttactggaatgctcggaataagattgtttttctgttgtcatttttgctttttttacaaggttttttttctcctttgagattataatgaacatggtcacaccacaagtaaagtcagaagtaggacagagaacgctccgaaggctggtttggtcatccgagatcattaaaaatggctgaccctaacaatatgtacaaaaatataaaatgtaaatacaaaatacaaacaaatttcctttttaaagtacttttaagaaaaaaaagcagggccttggaagtattggttctgttttcctccattttctgcctcttccacaacttccttcttctcctttaagtccatggtggtgaattcggagctggtgtctacggctgcgtctgacat

SEQ ID NO: 4368 - DNA, 239 bp, Homo sapiens
  misc_feature (1)...(239): n = A,T,C or G
cacagcaggctgggagctctgcgttctctcccaagtaggtctgatggtcacgatgttctcatcagccccattctaggcgcctatgcaagttccaaagaagttcattcctagacctcttnaaggccggtgggtgagccactgctcatgccaggatggacctcatacatactcctgccttcttgccaacccaagggctgtcggtggttttaaaacgcatcatggtatggattccttttttt

SEQ ID NO: 4369 - DNA, 487 bp, Homo sapiens
ttttttttttgcttcttgctggggtaaccttaattatattcctagtgtcactgacactagtttaaaaacagcctgcaacaagaatattctcatcaccagccaccttttccacctttcttctttttctgttgctgtttcttttttgttgctggagcccctgcaacaagaatattctcatcaccagccaccttttccacctttcttctttttctgttgctgtttcttttttgttgctggagcccctgcaggtttctggtgtcttgggggtatgatgttacttgtagaggcagatactgttgcagcactgccaggtcttggggaggtgggtgggctgctcacagttttactggcatccacttcagatgaagctcctgcagttgctccctgggtcccttttccaatctgatccttctttttacccttctttcttccccggtagtaagaacgttctcgcattggcagccatctttctggatctggggtaact

SEQ ID NO: 4370 - DNA, 479 bp, Homo sapiens
tccttttttgctgtctagtcatcctcgtcggtcttctgcttcttggtatcgacatcgtcatcctcatcatcttcagctgcccgcttgcccgtagctgactcagcttcctcatcttcatctccatcctcttcctcaccatcaccttcttcttcctcctcctcttcctccccaccttcttcctcttctggcagtcagctactgggttaggattttgttcactgtagattaattttgcctattctagaacttcatataacggactcacttatgcagtatgtattctgtaagttccttttactcagcatgtttgtatgttcatcagtgtgtttaagctttgttcctttttatggctgagcagtgttctatgtatgaatgccacattttaaacgtttcacctgttaggtgaacaactaactggtgaacaatgggctgtttctagtttggggctatcatgaataaagttggtatgaacatgtaac

SEQ ID NO: 4371 - DNA, 822 bp, Homo sapiens
tttttttttgtttgtttttaaagttggaggtctcactctgttgcccaggctgtaaaaaaaaaaaagagagagaaagacgacaggaacttggagaaattgtcactgcatcatataacttctcatttaataatttcacagaagtcaaatgcaattttagaagatacttctacaaagttatatgcacgttatatttacagataagtttaacaaacttccaaccttcagctttttgtaggattttcatggcctggttcagctggccttggcctatacagtgcacatgcagtgttgtagcacagctcatgtgtgccttcttggaggcccaggttctctggaaccactttttcccaattgctttgagctgcaacaactgctgaaaggtttgttttcctctcctcatcataatcatcttgggagtttcggacgagatctcctaataacactgcctaagcattcatccatagcgttcccaaacggtaataacacttgtcccataaagctccttcagtttgtctgtctgctggttggcactttctattgtcttcaaggcattctcaattctgttcagcctgtactcgcaatatgccttttcaaaggagagagagttattggctaacactttggtgtgagtattgatgacattcaaagcttccttgaaacttccattctggataaggcataccactttacacatgcagggcagttacgtcatctttgttgatctgtagtatcttattgacggtcttgagagcgcgcgtgaagtcgccgttctggccataccggttcacttcactccacagcgcaggtactgacaccccaccg

SEQ ID NO: 4372 - DNA, 630 bp, Homo sapiens
taaacaatctttttttcttttttttttttcttaaatgtaaaaaacacctcggtacagcagagacagacacgaagggcgcggcgggagggctgcatgcaggggcgtgcattggctgctgccgcttttgtaattgaattgttttaaacctcaaacaaacaggactgccgctgtcactcaggccctccagagccactggctgcgaaggttggacctccggctggaatctcctaaagcccctgtcaaacaggacagaatgtggtaacagaacagaggacaatgagcacacagatgagttccagcgactttagcacgctaaacacatggccaagtcggcctgagaaggtggggaaagtgggtgaagctaatgcttaaatacaaaactgcctcccatttgctaagcactaactaagtgctttacttatagtatcttacttaatcctccccatggtttaattgagttaggcaccactctctgcctttctttgacagctaaggaaacagtttagggaggggaagtaacctgtctgaggtcatccaatttggagtcacggagccagaccctagtctgtctgatttccaagcataacttattgcaaccattctgccatctttgccagtcctctgggacgc

SEQ ID NO: 4373 - DNA, 2271 bp, Homo sapiens
  misc_feature (1)...(2271): n = A,T,C or G
tttttttttttgttagaacaactcagcaaaataaaattcctgtttattgttggacaacattgtttcacacatacatcaaacaggccaaaaaaaataaacagcaacttcatagacaaaaaaggaaaaaaaaagaaaccttttatctttggcctttttaaccatctcatacaaaccaactacttatagtacagctaagtacatacacaaaaaagttactggaatgctcggaataagattgtttttctgttgtcatttttgcttttttttacaaggttttttttctcctttgagattataatgaaccatggtcacaccacaagttaaagtcagaagtaggacagagaacgctccgaaggctgggtttgggtcatccgagatccattaaaaatgggctgacccctaaacaatatgtaacaaaaataataaaatgtaaataaaaaatacaaaccaaatttccctttttaaagtaccttttaagaaaaaaagccggggccctgggaagtttttggttcctttttcctcccccggttgcaaattctcatgggtttgggggtngggtgggtggagagcgccgttgtcatctgcggggtgggcactgcccacgggtgggcgggcgggcctctctactcgaaggtgaccacgtttagattctgagacgggaagtggagggtgaataggtcacggcggcctttttttttttagtttaacttttccttttttgctgtctagtcatcctcgtcggtcttctgcttcttggtatcgacatcgtcatcctaagcagagaaagactgtcaaaggcccctccaaccccaggagccctatccagcccactgcctcagctcctgctggcagagcaagaaccagggacccccagctccacagcccaaggcctctgggaagttgagcccagccctgtttccttcctgttcttaagattcaggaccacacagtggccacctacaaagtcagaaacagtccctccgcagcttgagcacctcagctaaaggcaggtggggagacccagatgccaaaccccccttcttctcaagccagaacccacctcatcatcttcagctgcccgcttgcccgtagctgactcagcttcctcatcttcatctccatcctcttcctcacctggagagaatcaaaggccaggtaaaccacacttccctcctactgtggctcctggggaaatcccgaggaacatgtagtggactgcaaggtccctgccctgcctctactgcctgcaactgggcccaatcagggcacccacgcccactacacaggtgggactctccagaggagagaggcccaagcagctgcaccccaaaaggccagcccaatagatcagtggctttcagagctgcacgaaagaaactttcaggtgtgcgagtgagtgtgagtgggcatgggcacaactccatgtcagggagaccttccctgactctacaggtgggtgcccagggccatgtggtccactggccccaagtaccattgtcccactcccaggagccccaattccttccttccccttctgccagacaaggccaggaaaaagtacctgaaaaggggaagatagacaaggctactcaccatcaccttcttcttcctcctcctcttcctccccaccttcttcctcttcttcgtctacctcattgtcagcctcctgctccccattttcctcattctcctcgacagaaaacaggccatgtcattaccagctggccccaggctggacagagcgttgctcctgatgcccggcctcccaccagaggctggcggctgcatctacagcccagccaagccaagcccaccccagagacccttctccagtcaacaccctccaggctccatcatgaaacctgcacattaactgcccaggaacaagggcttttccccaccctggccaagcccaaactcagataccggagtctcctctgaacctattcttgttcaggcgctgctcgaaaggtttttataaatatttaactagcaataatcgcgcctcgggtaaagctcattggctacgatactgccactgtgcaaagctatacatatacacatacacacacatatataggtatgtttaaagtagaacaggaaaaattttgtggggcggtagctgccagggctcaggagcaaagcagacactcacagcattcccgttagcaggggcgtctcttccattttctgcctcttccacaacttccttcttctcctttaagtccttcaaaagggaagaaggaaccagtaaccagtaagtcttctgag

SEQ ID NO: 4374 - DNA, 1576 bp, Homo sapiens
tctctcttctctctctctcgggacaaaaaacttggactttcgccgaaagtgggacaaagatgaatatgagaaactcgccgagaagaggctcacggaagagagagaaaagaaagatggaaaaccagtgcagcctgtcaagcgagactttttacggcatagggactacaaggtggacttggaatccaagcttgggaagacaattgtcattaccaagacaacccctcaatctgagatgggaggatattactgcaatgtctgtgactgtgtggtgaaggactccatcaactttctggatcacattaatggaaagaaacatcagagaaacctgggcatgtctatgcgtgtggaacgttccaccctggatcaggtgaagaaacgttttgaggtcaacaagaagaagatggaagagaagcagaaggattatgattttgaggaaaggatgaaggatctcagagaagaggaggaaaaggccaaagcgtacaagatagagaaacagtcggagaagaaaaggagggctgaggaggacttgacatttgaggaggacgatgagatggcagctgtgatgggcttctctggctttggttccaccaagaaagagttactgaggctttctgtgcttggcctgacctttggcctatgctggacctaactttgcgtgtgtgtgtgtgtagtagggggtcatttctttttgggtaatgggaaagttcttaagagtgtcaatggggagggatagagggtgggggctcatggtttccctctactttgggagagggcacagattgcagaggtaatgctggtgggcatattgcttctgcctcagtgtatcactggagtcacaggaccctgcccacctgagttcccaataacagaaaaacctccccttgctgaggcctgctttcccaaaactccccctgcatctttatctcttcatctatcccacctcttgtctgaacatcccaccttttatcctgtgttctgcctttgttttaattttaactcatgttccatcctgcaaaccagaagcaattctctaaagtccccagtttccccagttgattggcatatccctggatcagccccttttcccccatccctgcccctatggttcctcctagcccacctgtgccatgccatgtgtattttctggccggggttctatgggtgtgtgggatgtgtgtggcatggaatctgttcatataggagggggggtccgaggttgggaattcccaggaggcattggcctgccctgggggccttgatgtttctttgggctttcctcagagcatgtaatcaggaaattaaatggggatgagtgtttgggtgtgggtttgtgtctgatgagtttttttaacattccaggtgtagattgtttcagcttctcatggtttcattttcctgaagatttatgtttttgtctaccttgtgagcaggcttttggaagaacctgtttgatgcaaaaaagaaaatgaaaaacaaaacaaaaaatccccaaaaccttattatgggagcccgtcggttttagaagctgtttgacatgtataataaatggcattggctgggaaaaaaaaaaaaaaaa

SEQ ID NO: 4375 - DNA, 3436 bp, Homo sapiens
  misc_feature (1)...(3436): n = A,T,C or G
ttttttttttttttttgactgtttaaaaggttattttattaaatattttcagttcaaaggtttcattgtaacaaaagctatgaaagggtctaccaacattcagaacaaacactatttttaaattatttctatgttgtcatgcaaaaaatttctgcatcaaaatgccttcccgtttcttgtttaaaaaggtgattttttaatagtctattgtctatagatgctggacattagcccccagaagagggagtaggaatggctaaggaagtgggggctgggaggcaggccatatggaaggctatgggggtctcaatggaattctaggaccatttgttctttcaaggccaggcaaaacggaaaccctgtggttgaagggattttgcgttgctgggcactggcaggactgcaggggcagggaaagggctagggccccgggggctggggacatgcatgaggtgctcgggaggagccttggctaaatccaaaggcaaccaggcaccctggtgaggtctgctcctccttcctcagctggctccccaaagtaaaacttgtagctttgccctcttctccccagctctcgtgcctcctgaaggtaagtcccagggaactggaatctacccacctttcccccaaaaagtggagatgttggtgcagataaatctgcagcgttgttttgagggaaaccaaggcccatgacccaattgctccctcccaattatccttctttgcctatcctgccttagggttaaaagatctccttcctcccctggaatggaactcccttgagccacagagagggacaatgaaaggtaaaaagccttggctctggacacctcttttgggttacatgcggggaggggtgaatgccccatgcagattgtccagcagtaagtctatacttcagttggtcagtaaagaggccttcttgtaaggacacctcttctttcttgccagagcagtcaggtcaatcttcaaagacaggaaaagagatggacgtgcagcaaggaagaataagaagggaggcagccccaaaggcagcctgaatgcatagaaacgaccaccacctcttctcccactgcctcactcctccccatcccacagggggcacttggcaagaagcccaggcccagatgagggtcagcatggggaaccactaccgtgaaaaggcaagacaaagatggtccagatcaagcaacaagaaaacaaggaacccaaaggcggcacgggagccctgacccagggcctggctctctccttgccaggttagaagaaaacacgaagcaaagcagcaacaacccctccccctcctagctgcagggataaggcctcaatattagggcccacatgcattgtgcatcctatagaaatggatgagtgagtgcatgtcagactaacacgaggtttctcatcggcttcatggcgggtacacttctgcagcaccaattctcttcccttctacactaaacaacgacacgtacacgcaacgtccgggctctcagtcctgaggccaccacttctcaagctgcctccaaagcaggctgggagctctgcgttctctcccaagtaggtctgatggtcacgatgttctcatcagccccattctaggcgcctatgcaagttccaaagaagttctttcctagacctggggtaagcaggccacctcaggagctgcaatcacatcacggcccccaaagctctgtcagagttcttgcctggtccccctaagtccatggggaccanagaggccaagctcacctcttcaaggccggtgggtgagccactgctcatgccaggatggacctcatacatactcctgccttcttgccaacccaagggctgtcggtggttttaaaacgcatcatggtatggattccttttttttttaaacaatctttttttctttttttttttttcttaaatgtaaaaaacacctcggtacagcagagacagacacgaagggcgggcgggagggctgcatgcaggggcgtgcattggctgctgccgcttttgtaattgaattgttttaaaccttcaaacaaacaggactggccgctgtcactcaggccctccagagccactggctgcgaaggttcggacctccggctggaatctcctaaaagcccctgtggctgagctcactgcagcggtgcggcagggggcccctgagcagtgatagtggacattgagccacttgccattcccgacgggtgccagacccgggtcttcttctgactggctgggttcgaaggccgaccctgcccgtcgaatgttactgggtgaggcggatgtaaggcgaatgcacgctgcgtcctccccaatcacgtggacgtgtgggtttaggattggtggtatggataggcttgctgttcttggacaggagaatctccaagtaaaacttatggaaatccatcccctccacgaggttaccaagggcctcaggctcaaaggaagtgaggcctggatcacaaatcttcgtgtaggcctcaaagtccccattgttgatggcttcaatcagctgttctgtaatcttaatgatctcctgttttcgcactttgaggtcctcatcttctgtggtggtgttgcagctctctgtggagcccttgatcccatctgtagcgttgtgtaccacagtggtttgtggctccttgacaccgccatccgacttcttgttcaataggcttttggcagctgagaagttcctggagacaagcatggtcgtgaggatggcacccttcagttttctccgggcattgaacttgcgcaaacactccacagtctcctgacgatgcatcatggatgccaccgtggatcgttgacagacccacgggtgcttgagagcctggtcagccgtgatgcgctttgctgggtttatggtcagcatctggttgatcaagttcttggcttcaggagttaccgtgtcccattctggtgatgggaaatcataggttccagccttgatctgctgatacagcttgtgctgatcctcatcccagaagggagggtagcccaccaggaggatatacaggatgaccccgcaggcccagatatccacaggttttccatagggatctttcctcaagacctcaggggacaagtaacctggggtgccagcaaaaccaaaccaagcctgctgctctccctgtacttcgatggctaggccaaaatcagccagcttgacggcggcacccttgcatttactcgccagcagcaggttctcaggcttcaggtccctgtggacgatgtcatgctggtggatgtggttaacactctccagaatctgatgtatacagtggctggcatcagcttcactgtagtactctctggccacgatgtcttcaaacagctcccctcccgtaacaaggtcaaacacgaggtagtgaaacccttcttcagaaatactgtcatggaggcgcacgatgtttggatgtttcagaagtcg

SEQ ID NO: 4376 - DNA, 1591 bp, Homo sapiens
tcgacttttttttttgatagaacaactcagcaaaataaaattcctgtttattgttggacaacattgtttcacacatacatcaaaacaggccaaaaaaaataaacagcaacttcatagacaaaaaaggaaaaaaaaagaaaccttttatctttggcctttttaacccatctccatacaaacccaactacttatagtaccggctaagtaccatacacaaaaaagttactggaatgcctccggaataagattgtttttctgttggtccatttttgctttttttaccaaggttttttttctcctttgagattaataatgaacatgggtcaccacccacaaggtaaagtccagaaagtaggaccagagaaacgcctcccgaaaggcctggtttgggtccatcccgagaacaattaaaaaatggctggacccctaaacaaatatgtaacaaaaaatataaaatgtaaaaataaaaaaatacaaaacaaaatttccctttttaaaagtactttttaagaaaaaaaagcagggccttggaaattttggttcttttttccctccccctgttgcaaaatcctcatggtttgggttgggtggtggaagaagcgccgtgtcatctgcggggtggcaactgcccacggtgggcggggcgggcctctctactcggaaggtgaccaacgtttagattctgaggacggggaagtgggaggggtgaatagggtcacgggcggccttttttttttttagtttaacttttcgcttttttgctgtctagtcactcctcgtcgggtcttctggcttcttgggtatcggacatcgtcatcctcatcatctttcagttgcccgcttgcccgtagctgactcagcttcctcaatcttcaatctcccatcctcttcctcaccatcaaccttcttcttcctcctcctcttccttccaccttcttcctcttcttcagtctacctcattggcagccctcctgcttccccattttcctcattctcagcattccccgttagccaggggcgtctcttccaattttctgcctcttccacaacttcacatcttctcctttatgtcccttgggtggggatttcggagctgggtgtctacggctggcgtctggacatggtgggggcacgccgggtgaatccggatgcagggggattaaaaaaagaaagcggagagttcagggaactctgggcggataaagctggccggagtccgcggcggcggaggaaggcgcgcggcggaggcggcttgcggcgagcaaggaaggcggatgaaggaacaatgcaaagatggcttttcagagcagccagttggggactcacgcggcgccagaagctttaatatagattagtgggcggcgctcggcttcccatgcccggccgctattggctgagcgcagggagcgggcgctcgctcattggctcgattccgaacaatggacaagcgtgcttaaagcggcagtgccccggcgtcccgcctgcgcagtcgccgatcgcactgtcattcaaggccggagtttgccgggtctcagcagggccgagggcgcgggggaggggtccgacgcgttccggacgcgcgctcccgcag

SEQ ID NO: 4377 - DNA, 3675 bp, Homo sapiens
  misc_feature (1)...(3675): n = A,T,C or G
tttttttttttttttttttcactgctaaaatattttattttaaaatgtaccacagtgaatcggatgtatccatactggttcttataaatgtacacatacacatccatatatttgacaaagtatatatatgaactggttaaagacctatccaaaagaggaaatatttctagaaagttcatcgtgtttatacttcatttgacaattaaaacttatttgaactgatgaagttttagttgcttagcaatgactaataaataccaatgcctgtcaataatgacaactaaattgagaactataaatttcactgctgtgccttgggtcaaaattttcaatgatgggaaccctaaataagtaacagttattcctataatggggtatatattcagaaggaataaatacctgccactattaccaaaagactgttctctgtagagctcaaaaaaaggattatgccacaatacataatttttatttaaaaaagatctctttagatgccactgcaaattctgcttttactaaacagaaaggcagcaccccatttctttcttgtaaaggaggaaagtctttcataaaaaactctttgaagaagttttggtagtatgttcagagtcaaacacagcagcactttattaacaaggacagagtaatataatcacaaggaaatacttgttaagtctaaattaaatgatatcttgggcagcataaaatgaatactaacaagggcaggcatctcaatatgtctgtctcacagctcgttcaatgtgaaagtagtttgtaaggcaagggaaagacaaggggcaacatttacacccacaaattgactgtaaaatacttcattacattgaggaaagggtaatcaatggtcaaaatccataaccagaaggagacaccattttgagtatctatcaatggggccaaacagacctgtttagattttaatactgcctgggtatgcaactccggatactgatttctttctctatggaggaagccaatgttcatgttcttgataacgagtcattaatctttctgattgagacagtccaaacccatcgtcgacctcagaacactgggtctaagagtgaacttcttacattgatatattttccttgagttctttcatggtgctgtatcagcatgctaccataatctgaaaatgacatggggcacaaaggagccatatatatatatttcatgtttatatatatatatatatgtatatatatatacatatatatatatatatataaacatgaaaagtatcccatattccagtatcacatgacagaaaatttatggttaaattatttaagacatttactttatttttcttgtggccatccatttagtgaagaacatcagtgtattaagaaggtccctctttatcacatgatatttctaagcagatatttaggaatgctcagaagattcccactttcagtctcctaagacataatttaaagtgaagacttgaaaccagaaaaccaagtatccttcctgaactcctaagcctgaaaatccgtagaaatagtttcctgttttaaatccctgggaaaccttagataaggtatgtgaaactgaaaaaagatcgaatcagcacacacagataaaggatacaacagataccaagatgggtaaatgcccaattattttcagtcctcataatctgtacaaagcctatgaggccaacccagtaggcccatacctcactaggcaagactttgaaggaagaaggtttccctatcttgaaacacaagaaattatgaaaatatcggagatgaagagggagtagttctgtgcttcttgctgtgttacctttattatattcctaagtgtcactgacactagtttaaaaacagcctgcaacaagaatattctcatcaccagccaccttttccacctttcttctttttcctgttgcctgtttctctttttgttgcttggagccccctggcaggtttctgggtagtcttggggggtatgatgttacttgtagaggcagatactgttgcagcactgccagggccttggggaggtgggtgggctggctcacagttttactggcatccagttcagatgaagctcctgcaggttgctccctgggtcccttttccaatctgatccttctttttacccttctttcttccccggtagtaagaacgttctcgcattggcagccatctttctggatcttggggtaacttttgggtcataattctctaggcaatattcccttctttttctttctcttctttttcaaatctccctgtccttgctccttcggttgactatctccactcactctttcacccttcttccgaatgtatgcagcaccagcagaatgtttcagagcctcaacatctactgttagagacgtactatctgacgatggcaagtgtttactaagagctttggctttctctggatctcacaagtgagtaagcagaaataagctgtgccacgccgtgtgaatatcttttggatttttgtttcacaggctggttgtaggtcactaattgcctccttcttccgcccatatttgaagtttgaaggtttgcaggcttctcttatcaagggacaaatgaggcagggaggattttgggctggatgggttttggataccactgggataggcttgtgtggaaggacctccaatgggcactatcaatatcttcttccatggccaatacatggtaaactaatgccagaatacccatgccccggtttatgcctttaactccccctatgcttcctcaatattagacatgctttagaaatattacccttgagaaattttcaactggtgcccatgggtcagcttaatttcagctgcattctcctggatggctgatctgaaaattcctgaagcagctctattgccttttgtgtgcctgccttttccacgggcangagctgggcagccttggaattaaacacaggtaagagatgcctcgggactttgggactgtaaactggcagatattttgcggcattgttcagccctggtttgtgtacatagcaagtaaagctttgttaaattctatagcttgtagttgtttcttggaaagcttaaactctactccttccgcattggttaatttcactttcttcttggagtcaaagacattttggtccttgttaatggtaatgatgttatttgcaattacagctagtaatcccacatctgttggttttagttttattatttgattgtaaagttgcaaagcctcctctgttcgaccctgaagctgcagaatataagccatctgaccatgaatgatggccagttctgcctgtgggtcttcctcagtcccatcagtgtcttctgataatgaacggcggcaaagatcttcagctttttgtaggattttcatggcctggttcagctggccttggcctatcagtgcacatgcagtgttgtagcacagctcatgtgtgccttcttggaggcccaggttctctggaaccactttttcccaattgctttgagctgcaacaactgctgaaaggtttgttttcctctcctcatcataatcatcttgggagtttcggacgagatctctatacactgctaagcattcatcatagcgttccaaacggtataacacttgtccataaagctcaattcagtttgtctgtctgctggttggcactttctattgtcttcaaggcatt

SEQ ID NO: 4378 - DNA, 363 bp, Homo sapiens
tttttttgaacacaagggtcagtttcttcaattcatgagcagtcagaacaggagatgcttaggaaggaatcgtggctggtgcctcttctccatgctcatcccataccccagtgacaggataccgcttccctgaagttaaaaacatgcaccacacttccggtaaaggctggagccacagagggcacctagcaagcttgctttcaaggtcccatcaacaaatgagaagggcagccgaggacagattgacagaaaccccactatgttgcttttctttttttttttttttttttttcctgagacagagtcttgctctgttgcccaggctggagtgcaatggcacaatctcaactcactgcaacctcc

SEQ ID NO: 4379 - DNA, 611 bp, Homo sapiens
ttttttttgcaaatgggagttccacctcttggtttccccaggcctagagtgcaatggcgtgaatcttggctcactgcaacctctgcctcccgggttccaagcaattctcctgcctcagccctcctgagtagctgggatttcaggcatacgccaccatgcctggctaattttgtatttttagtagagacagggtttctccatgttggtcaggctggtctcgaactcccgacctcaggtgatctgcctgccttggcctcccaaggtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatgataaaaaaaaaaaaagaccttgaaaatgttgtgtaccctgtggatttgaggcttattactaccacctggctggataaaatgtcaaaaccttcaatcacttagggtgactggaactttagt

SEQ ID NO: 4380 - DNA, 596 bp, Homo sapiens
taggaggcacagcacttccagggtcacacactattaagtggggagctatgcaccctgcttcatggggcgctgcagcccactccttgcatgtttggtgactgcaggttaagatagtgccagttccactgttgggcctcagggtcagtgctactccgggtaccagtcggagaacattttgtggtgatctgatgccatttctctctgttgccctacccatgtgatgtcaaaccctgtgtatgttgcagttttttggaagcggttgacttgggctagtgctacttgaacactcacagaactttggccccctaactctggctgcaaaccagacttatctaggagactttgaaaagtagattccgggccaaagtgctgggattacaggtgtgagccaccacccccagccgcctctatgctttttgtttctttgatatatctaaacttaaggtcagaacagaaattcatgtgctgaacagaatggattctttttgcagtaccaatccaattgaatcctctttttattttcctgcgtccttaccagtcactttgatagtgctaactaacctacactatgggggttattcatgaattaagtatga

SEQ ID NO: 4381 - DNA, 225 bp, Homo sapiens
ttttgcattttgtgtcatcgtgttggctgatgggtacattgtcaacaaagctgtgccgggattgcagcagtttgagcagggagggtgtggggtgggacctactgcataaacagagattttattagtggatagttctctgaatatagccttgaaactgtaaccacccaacgggttcttcttgcctgacagccgatttatcaggacaggagaattgcaatgtcgacg

SEQ ID NO: 4382 - DNA, 624 bp, Homo sapiens
ttttttttaatttattttctaagtcttctataaatttcagtacttatcttgcttgttctcttagcagaataacaatgttaactacttttcttttctagaaacaccctctctcttactttcacttctggcttccctctgtactacattcattttatgatactgtccaatctacacccctctcttctgaaaacttcccccacttggacccagcagtgtggccctggagacatgctcatcccctgtgatcctgctcccttgaccacagctacttggatcaggaatgaacacttggcactagggaagcaaaaccattggctgtgctgagccagtcagattcttttttctaaaagtagctgcaaataaagtcagaaagagagtctctactgtgtgcttgaatttataaaaataaaactatgagtgaggcagacatgtgcgtatgaaaacagaacatttttaatttttttgtattttttacttattttttgtttgtttttttgagggagggtcttgctctgttgcccaggctgtagcacaggaggaagaatcaaaactgagtccagcagtttccctgagttaaggggagaaagactagtatcctcagaagccaaagaggctgtaatttgc

SEQ ID NO: 4383 - DNA, 449 bp, Homo sapiens
  misc_feature (1)...(449): n = A,T,C or G
ccaaaacaagcagtgggccantccatggaggtttncccgggaaaaggggtggggaaantcccggaactgagagttccctccccccctttaatccatatagggtagantcccagatgttacccatgtcatttgtaaactgtcatggcactggtgagagtgtcttttacccatgctaatgtataagaaccttaaggatgaccagaggttgctttcgttgccatcttggtttttgtgcgttcttctggctgctttacgcatctcattttaccagtggggtctttgtgatttgtaccttgtaaaaccagtcctgccaaactcctgtctcatcatgagagaatcagttgagccaacggaggttgaggctgcagtgagctgtaatcatatcaccacactccagcctgggtgacagagcaagaccctgtctcaaaaaaaaaaaaaaaaagtcgacg

SEQ ID NO: 4384 - DNA, 486 bp, Homo sapiens
ttttttttggagcaacatggctgtttatttcacctgggtgcaggtgggctgagtctgaaaaaagagtcagcaagggtggtgggattatcattagttcttataggtttgggataggcggtggagttaagagcaatgttttgggggcagtgggtggatctcacaaagtgcattctcaagggacccagccctctattttcaaagaataggttctatctaatattatcatggtaaatatccatattagtttaagagagaaatggaaattatttttggatcccggtccttcactcatcaaagaaagcaggacagaatgcacattgcactattcaatttgttgatttgtcctctgtcatcttgtggagagtgatagagtattttttaatttcttcaattaggatagtccaattgcaataaggtggcataaacatgctgtctcatgcttaaatagtaaagactagtcagcagtcagttatatatataattgtc

SEQ ID NO: 4385 - DNA, 626 bp, Homo sapiens
  misc_feature (1)...(626): n = A,T,C or G
aaaaatggttaaccgggcccccccctcaagntttatntatattttttttgtgaacaataaagctttttaatcacctgggtgcaggtgggctgagtccaaaaagagtcagcaaagggtggtgggattatcattagttcttgtaggtttgggataggcggtggagttaggagcaattttttgtgggcagggggtggatcttacaaagcacattctcaatggcggagagaatattacaaaataccttcttaagggtgcgggggtgcgggcgtggggtgggtggggagaatattacaaagcaccttctcaagggtggggaaggtgtattgtcacaaggtcaattgatcagttagggtggggcaggaacaaatcacaatggtggaatgtcatcagttaaggcaggaactggctattttcacttcttttgtggatcttcagttgcttcaggccatctgggtgtatacgtgcagggcacaggggatatgatggcttagcttgggctcagaggcctgacagtgggtaatttccactctctttgtctgtagtttctgaatttcttacaagaaacatgtataagaaatatgacaaaagttattttataaataaagggacacttccaggcatttcag

SEQ ID NO: 4386 - DNA, 379 bp, Homo sapiens
  misc_feature (1)...(379): n = A,T,C or G
tggagcaacatggctgtttatttcacctgggtgcaggtgggctgagtctgaaaaaagagtcagcaagggtggtgggattatcattagttcttataggttttgggataggcggtggagttaagagcaatgttttgggggcagtgggtggatctcacaaagtgcattctcaagggacccagccctctattttcaaagaataggttctatctaatattatcatggtaaatatccatattagtttaagagagaaatgaaaataatttttgaatcctgttcttacagacatccaaagaaagcaggacagantgcacttcgaggggggggccccgttaccccaatttcgcccntattagttgagttcgtatttaccatttcactg

SEQ ID NO: 4387 - DNA, 628 bp, Homo sapiens
agcaacaaggctgtttatttcacctgggtgtaggcaagctgagtccaaaaggcagtcagcaaagggtggtgggattatcattagttcttataggtttgggataggcagtggagttaggagcaattttttgcaggcagggggtggatcttacaaagtacaaagggtggggagaacattacaaagtaccttcttaagggtgggggagcatattacaaagtaccttctcaagggtggggagggtgtattgtacaaagtacattcacaagggtgggggaatatcacaaagtacattatcacaagggcggggagggtgtattgtcacaaagtcaattgatcagttagggtggggcaggaatggtggaatttcatcagttaaggcaggaattggctattttcacttcttttgtggatcttcagttgcttcaggccatatggatgtatacgtgcaggtcacaggggatatgatggcttagttgggctcagaggcctgacattcctgtcctccactgtaagagttacccaaagcatccgggatggtccaggaggtttttgaggcgatcggacagcgtcagtcttcagccgctaagccgagaagatctggaaagaagtcagtcagaccagccttggg

SEQ ID NO: 4388 - DNA, 613 bp, Homo sapiens
  misc_feature (1)...(613): n = A,T,C or G
tttgagcaataaagctgtttatttcacctgggtgcaggtgggctgagtccgaaaagagagtcagcgaagggtgatggattatcattagttcttataggttttgggttaggcggtgaagttaagagcaatgttttgcgggcagggggtggatctcacaaagtacattctcaagggtggggagaattacaaagaaccttcttaagggtgggggagattacaaagtaccttcttcagggtggggggggctgcaacgtaccttaatggtggaatgtcatcagttaaggctattttcacttcttttgtggatcttcagttgcttcaggccatctggatgtgtaggtgcaggtcacaggggatatgatggcttagcttgggctcagaagcctgacactgagctcaagcaattctcctgcctcagcctcccaaagtgttgggattacagatatgagccaccagcactggcctgattttttcatttttagtaaaaaatgcagtggtataagcagcaaaccnttaggtgccacagtaatgacaaatccatccattcaaatgagagaaagtcatcctagacctctattcctcttgaactctcttagccaatcagtcaacaaat

SEQ ID NO: 4389 - DNA, 389 bp, Homo sapiens
gtgagcaacaaggctgtttatttcacctgggtgcaggcgggctgaatccaaaaagagagtcagcaaagggtggtgggattatcattagttcttataggttttgggataggcagtggagttaggagcaatgttttgcaggcagggggtggatctcacaaactacattctcaagggtagggagaattacaaagaaccttcttaagggcgggggagattacaaagaaccttcttaagggtgggggagattacaaagtacattgatcagttagggtgggacagaaacaaatcacaatggtgagtgccatcagttaaggctattttcacttcttttgtgatcttaagtgcttaggctatctgatgtatcgtgcaatacagggatatgatggtta

SEQ ID NO: 4390 - DNA, 1821 bp, Homo sapiens
  misc_feature (1)...(1821): n = A,T,C or G
tttttttttccttttgaaagatttatttttaattaaaaaataaaagttatctgaacatatctgcattgcagtttcagggatggcaccttaacccatttatgccgaaggtcacaaatgttttttatgaaaaatcagatcttggtgatgaccttgagcagtaggatagaaataactcccacaagcttagggttccaataatggaaccctaggcatgaatgggtaaatgaagcaaaaaacaaaacaaaacaaaaaaaaaaccaaagcttatcagttcttgggtcttatgaccatcttataatgggtacaaaggcacacgtgtcttcaaacaaacttgattcagaaacatttctaacaactcagaactccccccatgtttttgcccaccctcacccccccaaaaaaatacaaccaaaaacattaaattcttttttaaaactacagaaataagtgctgagtcagcaaggaacctgggcatgctgcccacatgccgccacgtctctctgctttgatgactggctgcccagaggtcaggagggagagagctaagcactttccactgcatgctaggatatagggcttgcaacatagacccagccctacagccgtcaccccagctggggcaggcagctcctaggcgctctctcccttaatcaagggcatccacagctaaagcagcctttcaggaggtgacaggcccaagacaagcaagtctttgtcaaatgcttgcgatgacaaggccaatggtaactgtgggagggagggagacgggtagatctcttcgcccgcagtttactgggctgctggaaggttttctctccctactctccctgccttctctcttttcccttctccccagtctccctcttccctcaaaagggttttactttagcttaatggtgggggttccgaagagggtattggcaactcctggggcgggtctggtggctctgccatctctaaggggacatcacgtgctttcggttcctgtgcttcacagagctcctcctgcccctgagagggctccagctgctcctgaccctgggcctggctgttcatcttctcttcagcttcaatctcttctgatgtggggatggagttcttcttggggcgacctttgggttttgtgggtgcttcctgtccacctttaagaaccattttcttccatttcatcctgcgattctgataccaggtcttcacctgcagctgagtgagtcccagagactgagccaagtccaacctgtctggggttgacaaatacttctgcttctggaatttcttctccaggcccatgagctgcagctcggtgaagatggtgcgactccggcggggcttcttctgtcggggcgtgggctgttccgtctctgactcgctgctggctagggcctcgccccctggggcctcagcagagaccgcctcggtgacctggtggcaggacagtgcctgggcgattcccggggtggcagggaccaggtgggagatgacagtgggctggcgggtgatcaccgagaggagcggatatgcccgcagggaaggggagcccgtacaggaatgcaggggcttgggtcgcacgaccagcgacgggcacacggagtagagggaaagtttctcaaagtaatcgcaggtctccttggagaggatctcgtcgatcatgaaagtcttgtagcgccgcctggctgctttgagctggccgggcgagctcagcctcagctcggcgtggcagtgcatggtgagccggcgcgcgcgtccgccgcccgagcgcggttgcgagtgcccggcccgctggggccgcggggctggcgcgacggcggggnctgggcccct

SEQ ID NO: 4391 - DNA, 686 bp, Homo sapiens
  misc_feature (1)...(686): n = A,T,C or G
tttatttctttcttcctccngtgaatgattatatctttctaacttaaaaaaaatagagaagttattcttgaacaatattctgcgatgtgccagtcttcaagggaaatgggcacactataacccacatcttattgccggagaggtgcaccaagatgtgtgttttattgataaaactcaagactctgtggtggagtgaacctttgagncgagtagaatgagaaaatatacctcccaccaagccttatgggtgtccaattaattgggaacccctagcgcatgaatggggtaatatgtaagcataaaaacaacaacacaaacacaaaaaaataaccaatagcttatcacgttcttgggtcttatgaccatcttataatgggtacaaaggcacacgtgtcttcaaacaaacttgattcagaaacatttctaacaactcagaactccccccatgtttttgcccaccctcacccccccaaaaaaatacaaccaaaaacattaaattcttttttaaaactacagaaataagtgctgagtcagcaaggaacctgggcatgctgcccacatgccgccacgtctctctgctttgatgactggggcgggtctggtggctctgccatctctaaggngacatcacgtgctttcggttcctgtgcttcacagagctcctcctgcccctgagagggctccac

SEQ ID NO: 4392 - DNA, 521 bp, Homo sapiens
  misc_feature (1)...(521): n = A,T,C or G
tttttgagacggagtccttctctgtcacccaggctgaagtgcggtggcatgatctcggttcactgcaacctctgcctcccagtctcaagcgattctcccacctcagtctccagagtagctgggattacagacacgtgccatcacgcctggctaatttttgtacttttagtagagacggggttttgccatgctgaccaggttggtctcgaattcctggcctcatgtgatccgcctgccttggcctccccaagtgctgggattacaggcatgagccaccatgcccggccaaaaaacttgactattcttgatgccaagacaagagaaacttaattatgacgttagaagtttcaaaaatacagtgacttctgggacacttctagtagccaaaaatccacagatgcccagacccctccttctgcattccagaatcagatgtttacattccaagacagaaagaatctggaaacaagggctacaagaaatttgggggaatgncatttgntctcattttccccncaaat

SEQ ID NO: 4393 - DNA, 577 bp, Homo sapiens
  misc_feature (1)...(577): n = A,T,C or G
ttttttaaatgtcaaaatgatgagtcangctaatacattgagggtttgtttttttttttttttttttttttttgagacagagtttcgctcttgttgcccaggctggagtgcaatggcccgatctcagctcaccgcaacctccacctcccggattccagcgattctcctgcctcagcctacattaagggttttgtcagacaattgtcacacgaagaatagtgtcacttatctgctcttgacacacagaactggcctggcatatagctttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacctcatgatagcagtgtatatatagtcttgtttgtagttggaagtcatcttttaggagttattctcaaatatatataatagctacccatgcatcattattaaaatccccaaattcaaaaaacctctgatatatatatataa

SEQ ID NO: 4394 - DNA, 512 bp, Homo sapiens
accttctccttttttctttccttttcctttttttttttttttttgggggggggtagggggcggccagtggggaagcaatgggtttgagaggggaggcgggggtacaaatggtatgtgacgctgggatgtgttttaagttacaaaggcgaataatgttactgttgtattcttaacaatgaagtgaacctaccctgattttccactaagagtgataaatttggactgacatatccaaattctatcatggggttcataaagctagctagaaatcatatactcatcagcatggtgttttaattaccaaggcaccattactggctaggtttagggttagaacagttttaggtttacagaaaaattgtgaagatagtacaacgagttctcatgtgcaccacagccagtttcccctataatagtgacatcttacattagtatggtaaatttgacaaaattaatgaaacaatattgataccttattaactgaagctcatacatgatttctttagttttta

SEQ ID NO: 4395 - DNA, 526 bp, Homo sapiens
  misc_feature (1)...(526): n = A,T,C or G
tttttttttttttttttttttttttttttttttttttttttttaggcacatatttattttattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccacccttcatgcctgcattatgacagaaacacgtcccactgctcctacttatgtatgtacatccagagctccaaacctaagctgtggccccctcctcccagccctacccacatccaccctacttcccaaaagcctgtagaagcccccacttagaaaaaaaggcagacatacacatacacagaaacacatatctatctgcagctcctccatgtgaagcccctgaaacatacacaccctggaactttcctctccttatggcacagatgggacaggntggcctttcccctgtt

SEQ ID NO: 4396 - DNA, 546 bp, Homo sapiens
  misc_feature (1)...(546): n = A,T,C or G
nnagagcacatatttattttattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccaccctgaatatctggggaaccccccccacacacacacacccctgcacacacatgcacacacatgcacacacatgcacacacacacatacctgctgcccattctcttcccttggggnggacaaaggggtgtnttttgaccccaaattccgggtttccccccagcttggggggcagttggccttaaggggtgctttttgggggcagggtccngtggggaatcctgaggggggcttgtctcgtngggggntagggggtaggatagggggagcttctttaggnctttnaaggggttgggntccttnaggggggggctttntttggggagttgggcctttgggncagtcagttg

SEQ ID NO: 4397 - DNA, 427 bp, Homo sapiens
tgaggttttaggcacagatttattttattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccacccttcatgcctgcattatgacagaaacacgtcccactgctcctacttatgtatgtacatccagaggctccaaacctaaggctgtgggccccctcctcccaggccccacacacacacacccctggcacacacatggcacacacatggcacacacatgcacacacacacatacctgttgcccattctcttcccttgggagacaaaaggatgtattgacccaaat

SEQ ID NO: 4398 - DNA, 561 bp, Homo sapiens
  misc_feature (1)...(561): n = A,T,C or G
aggcacatatttattttattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccacccttcatgcctgcattatgacagaaacacgtcccactgctcctacttatgtatgtacatccagaggggtaggtagcaaagatgccggctgtgccattggggcccgaaacaaaaagctggttgtcggcgaagtgccagattgcatcataatacagcccaaaaactattccagcacccaagaaggctcccagcgtctgtgccagggtgtagatgggcagcttgatccagggctcacgagccaggaagcacatggcanaggtcacgggcagggtaagtgggccccagagacctggccagcgatgagatgcccagagtgacagcanagccaaaggcccaggtggaagtgagaaaccaacctggtgcccc

SEQ ID NO: 4399 - DNA, 234 bp, Homo sapiens
tgtgaagcccctgaaacatacacaccctggaacttttctctccttatgcacagatggacaggctgccttcccctgtctctgggctcccccaatagccagaatcccttccgactggtcccttgccctgaatatctgggaaccccccccacacacacacacccctgcacacacatgcacacacatgcacacacatgcacacacacacatacctgctgcccactctcttcccttggg

SEQ ID NO: 4400 - DNA, 476 bp, Homo sapiens
  misc_feature (1)...(476): n = A,T,C or G
ttttttagcaatgatgtgacaatgttaactttattactactgttaaggtaacagaatcaaagcttctgtagatctcaaaaacagaagtttattcataaaatgcatttttaaagtatgaccaaaaataagactacaaaacccctacaatcttgtacatttcaccatcacttaccacagtcaaaaaccaaaagtctcaccaattcagttcctgtattttaagtaaaaaagagctctttaaaatcaaagcattttgttttatgaattaaattgcagaaaatagctacccaaatctagaccaaccgtgccgttttgagatatatatatatatatatatatatatatatatttgtttttttttttttttgagacggagtctcactctgtcgccagggctggagtgcagtggcgcaatctgtagtcctcagcctcccaagtagctaggactacagatgcccgccatgacacccagcanattt

SEQ ID NO: 4401 - DNA, 562 bp, Homo sapiens
tttttttttttttttttttaagaagaaaaggctgtaattttattttcaaatttttggaagtttttcagaaaaaaataaaatgacaagaacacatacaaatattgaaattattcattgaactataaacacttagcagaggaagggacttttgatgtatttgaatccacctccttctgaaagcaggaatcacttctaaatgtctctcatatctttcttcaaggagtggttttccaggaggttcccagcctcctcaaatctttcccaagtttgatgcacttcacctcataaaaataatatatatatatatatatattttttttttttttgagacagggtcttgctctgttgtccaagattgagtgcagcagcatgatcaggactcactgcagcctcacctcacccaagctcaagcgatcctctcacctcagcctcccaagtagctgagattacagatgcacatcaccacactcgggtaattttttttactctctgtagagatgcagtcttgccatgctgtgcatgctggcctcaaacttgtaggctcaagtaatcctcctgcctc

SEQ ID NO: 4402 - DNA, 574 bp, Homo sapiens
ttataagaagaaaaggctgtaattttattttcaaatttttggaagtttttcagaaaaaaataaaatgacaagaacacatacaaatattgaaattattcattgaactataaacacttagcacaggaagggacttttgatgtatttgagtccacctccttctgaaagcaggaatcacttctaaatgtctctcatatctttcttcaaggagtggttttccaggaggttcccagcctcctcagatctttcccaagtttgatgcacttcacctcataaaaataatatatatatatatatatatatttatataaaacttgagacaggggtcccgctctgtggtccgagattgagtacagcagcatggtcaggactccgtggcgactcaattaacgagagcgtcgagcgattactaacacatcagccatcacgagtagccgaggattaaagatgggagattcgcaagcctagggagagtatattctataacacccggtaagagacgaaatgttggggtatgggtggggacagatgggggcacgaaactagtgaggggcacaaagtaagcagtcggggcctg

SEQ ID NO: 4403 - DNA, 798 bp, Homo sapiens
tttttccttcctctggcattccataagatacccaaaaatacacatggccactgacaccagagagatttgacaaattcttttaatcccaatacatatgttaactcaattggagtccctagaggtgtgcctaatgaatttaggcctaaaaccaaatagctgctgggttttaggactcttctgatggtcaactattaataagaatgtgaaaatggaaaatggaaaaaatggaaaggcatggtagctttaatccttacatctctcataattgtggcaggagtcttaacagcagtgggatgttgtattaccccttgtgtgaggggactagcacaaagattaattaaaacagctgttaataaacaaatgcccataacttaccagcaagataacctactactattagaaactgaattaaactcactctcctatggaaaaaaaaagtaaatgacttctagagcaattcaaggaccaaaaaggcttaaatgaaaatgagaccaaaggaagtaaatagaaaagagttaatagaaaaaaaaagagttaatagtaaatagaaaaaatagaaaagggcaaagttatatgtcaccattttaagggaagagaccacccctcatattgtcttatgcccaatttctgcccccaaagaaagaagaagtaaaaactaaaaggcagaaatgaaatccacaggcagacagcccagcgctgtgccctgggcctggtagttaaaagatcgaccctggcctaactggttatgttatctatagattccagacattgtatggaaaagcattgtaaaaatccctg

SEQ ID NO: 4404 - DNA, 523 bp, Homo sapiens
  misc_feature (1)...(523): n = A,T,C or G
tttttaaaaaaaaaggaagaaaatttttgtggcttgcccatcgaattgcataacattgttctagggggaaatgcattctgacctcaaactcacctaaaactacagatttttgaaacatgacatatatgtttagggcattacatgagaccacactttttctcacacatggtaactatatttcctttttcttttttttcttttctttttttttttttttttttttgagacagaggctcaactctgtagcccaggctggagtgcagtgatgtgatctcagttcactgcaacctccagcctgggcacagactcaggctgactcacagagcaagactcaaaaaaataataaattatcactaaatagtctttaatatttcttatatttagtacagnaccttcaatattcatcctccttagaactatcttgaaatcccttagctgtatacatttctcattaagagagaaaaaataatttaatttagtaattatttaaaaattttttaaagacatgggaaagttataatgc

SEQ ID NO: 4405 - DNA, 4706 bp, Homo sapiens
gtcacccaggctggaatgcagtagtgttatctcgactcactgcaacctccgcctcccaggttcaagtgattctcgtgcctcagcctcccgagtagctaggactagaggcatgcaccaccacaccaggcaaatttttgtatttttagtacagatggggtttcaccatgttggccaggctggtcttgaagtcctaacctcaggtggtccacccacctcggcctcccaaagtgctaggattacaggcatgagtcaccatacccggccggttatctgcagttttcaattctcagatttgctacatgaatatttttagcctacagaattcagattagctttgaggaaatgtggtgtgagagacacgtgtaaccagcagaaaatcagcttaggctacccaccttagcgttttgttcttattcaaacaggcaaattcttagtaaataagaaagaagtaaagtttgatctcaagaaaatatgagggaaggctgaaaagggccctgggttcagaaagaagggttactaaaaaggagataagccgctggacaacagatctccattttgcagaatgctaagacattgcacttagtacctcctgtttcccatgggttctgatccagaaatgtgccctgggaactgagcagctgagttaaaatataactcaaggcccacctgagtcgccaccttcctgaggcaccgtgccagcaaggtgcaccagtgtggcagacctggagactcactgtcccctcaggcttggctcatggactcagacacccacatgggaatgcttccagcctggattagtcattcaatgggccttcaatacagacaaaaggcaacaactgcacattagtgtatttctaaaattgggcaagttcttggtctctgtctctcttacagacacatatggacacattcacagaacacaggcaccatcgtgctctcacacccacacacacttatgagcttctcttgagggaaaatgagtaatattcacctaatgaccaacataaaatgaagctctgaatctcaataatacaaggaactaaaacttacaaaccaaactagtaatatgtaaatgggaattctgaactctcctttgagcctattcaatcacacagctattcttcaccagcatcttaggctctgcctggagggagccacagttctaggattcggtgaattctctgctgaaggcaggcaggattcctttgcttccatctgttatgtcttccctgcccactgcactgagtctcatgtctccatctctgcatctgcctagctactcttctgctctctataccaatatggaacaaaacggggaattcagaagtgccacaatacagctccttccctcaactccagtcccatcagagaaggcagagacagcctcctttcttccacaaaacaggcccactgcagagcatgctctggatgcagaggatgggcccacacaaggatgttcagagtatgcgtgcatgggaaaagatggtgacaaatgaagagtaaagtgacatggtgtatggacatggcaccagcttacagacttaggtctttgacaggatggtcatggttttgaggttttaaagaagctatttccctaaacactcagagaaggcaaagggaatgttatttctattgctcccaacattgaatcattcagaagcagaaattggaagagatttcctcactgagcaggtcccaaaggcagatccacttcttactgaggtgcatggaagcaagactgctgatggtgcccacctggggcctggatccaaatgcgatttctcatttctccctacaagaacaggcacctattcaagttctagggttttcacttttcaacctcactgtcattttatcccgaggctccaaagatgtggtcctgctaaggtgactcctgattctgccctattgttcaacaagaagggagccccatgtaaagaacaggctagaaaaggagagaggagagaaagggagcacaggggaagggggagaagaaggcaagggggaaggaagcaaggtcactggtcattctcttgctttccacttgaactatcgcactttaccttacccatgcatttctgagatgctaattaaaagatgtttcccagaggggctgagtgccagattaggaacagcacgttcaaccagattaagttggttgatctgcaaagaggccaccgcttctcctcaggggaacagttctgagtttgggccgaatcctctctgcagctttttgctagtctcttctctcagaaggcaaatgctgtttccgccctgggagaggagaagctggctttactttggaaccagcccccgagactgtggataaagctgagatgcaggggttcctgaggaagaggaggaggatcccgacttccttccacttttaggcctggccttggatttcttatttgcagtgctttcaaatgatgatgcatccacctgtatctcatcttcatcctgcagagccgcatccaatgcagcctggaccttgggggcaatggctggaccctcatagtctctggtggtccggctgggcatgtccagctctaacagcacaatgttttctgccctgtatcgggcctctggacgaatcatcatggacattcttgcgtgctggctcaatggtctcttatatcccacggctgagactggccgcttcatcatctgctggttctccagtctggttataggatgtagtttccaatgatcttcctcttcatcaaagaaggctctattcataattttacttttttcttccagagggataaagttttctataataagatgcttgagtttcagctccctggtgagctcattctgagtctgctctagctcttggcgctccttgatgtgttcttcttggaggtcatggatctcagccttcactgcctgaagcttggagaagagctttttgagttttttggtcttgatgtccacctcttgctgcaatgagctgtatgtctctttaagttccaaggtctcctcatctcgactttccatctgttgctggatttctctttctcgacgtttctgctctgcaatttcctgtcgtttctgctccaggattttctgctgttcattcgtatgatctactatattttttcctccaacaagcaacttactctccatggccttgatcttggcgcccagcatctcggcagcatccttctcccgccgcaggtcctccatctttttctctttctccttcagcagcctcatcttctcctctgcaaccaagctgtgatcctctacaatggcccgcttctcaatctccagtttttcttgctgttcccgccagtaatcatccttatcatccccttcctcctcaccctcttctccctcctcctcctcctcttccccacccccaccactgccaccaccttccctccgcttctctcgcctcttcctcctaccaatggaccgtttttccagctgggccttgagccgagcaatctcttcctggaattctcgaaggagggcatccttggggtcctcattgacccttggtttgttcttaatgtttttggcacggttggcatatcgcagagtggtcagagtctcttctacgttgtaagaggcaggccccacgttggccaccatcacagtcttggcattgccaccaagggaatcttggaggagcctggtaagctttgagtcccgatatggaatgtgagtgcttttgccgtccactagagcagagatgacattacccaaagcggaaagggagaggttgatcttggtagcttcttttaatctctccccttgtgcgccggtcttggcttgccgttcgctgccagcaagatctacaaggttcaattttcctacacggatgtggttttcaccatcgaggcccacctcgctgcactcaatagtgataacgaaaattgcatgagaacgcgagctgtgctcgttcatgttggtagcaccgacagaacggttctggttccccacattcatcacatgctctatctccttcacactcttggtgacaaaggaagacaggtctttcacatacactcctgtgtcaggcctctctttgagctcaagccttttggtctgatcctttgagagcaaatctcggatctcctcctggtagatctctaagtaagaagccctgaccaggtattgttgattctgggatcgagagatgtgggtgaagatatggtcaaatgagttaggaatgactcctcttttttcagggtcaccacggattccttccatggtgtaggtttttcctgtcccagtttgtccataggcaaaaatggttccattgaaaccttgcaggacagagtcaacaagtggtcggaacgtctcatcgtacagttcaaactgcttggcattccagtcatagacggcatcaaaggtgaaggtcttgggcatttcatgggccgtccctttggggttcttcacagacacctgccccagcttaacatccacatccaccactttgtcatacgaagcagccttttccttgccattcatgggccgacagcgaaccaccaccctgactgactctgagcttttcaactttgacatgatgaactctgatccagtcaaatcttgagaagtgtcaattcaaaatgtctcaggatgctacggtcctgaggcccgagccgaaagcgggcggcggcggcggcggcggcggcggcggcggcggcgggggcggcgaacccctggctcagccattccccgctgccccggat

SEQ ID NO: 4406 - DNA, 6180 bp, Homo sapiens
tttgcggccgccctttttttttttttttgtgttgcaaagcctttaattagaatgtttgtattttttacatcatgcataacttcacatttgtgattaattagtaattatttcaatacttgtaagctcatctgcctcagatttaatcataatacatgaattaaattaatcaaattaaggaacagcaatttagaaagaaacacactttaagaaatcaaaattctcaattcaggcagtctgtttctatcatttggtattctactcctttaaaaatttcatattgcccaacaaaaagtggttatttttactgtttttggagatgactgaacagatgaaggcatcagatgccttcatcagctggtattttgcctaagatctatttaagataaccttttcttatattttttacttaatattgggcataatcgtatcattcaagattaagtctgggttatttctttgataagaactgaatgtggccgggcgcagtggctcacgcctgtaatcccagcactttgggaggccgaggtgggtggatcacaaggtcaggagatcgagaccatcctggctaacacggtgaaaccctgtctctactaaaaatacaaaaaattagccgggcgtggtggcgggcgcccgtaatcccagctactcgggaggctgaggcaggagaatggcgtgaacccgggaggtggaggttgcagtgagccgagattgcgccactgcactccagcctgggcgacagagcgagactgtctcaaaaaaaaaaagaacggaatgtactggagatgtatttgataaccaaggttttaggtaaattttcaccagtattagttctatttgcaaactgaaaaatgttgtaggcttaatataaaataaccacattagtgaacattatatctcttagaagaaaggccatattttgctcctgcttctgtaaaaatattatttgtttgaaggggaaataatggtagtgtgacctttcacttaattcctactcccttaatgtgagagagacaaaatgagctgaagaaggaaaattctggagttacactccacaaccttgaacatactgacggacatctctgttttgacaacgatttctccatgccaccctgtagaaaaagatgaagcaaatggtgaaaggttaaaacatatccttcattgtaatatacatacttcgcactccttggggaaacaaatattttatcaatagataaaatagtaagatagacccagctattgctatttattaaatgaagatatgtatacaaaatacttcactcctacccaaatttctcagtagagcatagaatgccgaacataaagattgagtaatgtgcgttgtacagcagcaactgcaaagtgaattccacatttattttttatgtatttatttgagacagagtctcactctgtcgcccaggctgaagtacaatggcgcaatcctctgcaacctccacctcccgggttcaagcaagtctcctgcctcagcctcccgagtggctgggattacaggcacctgccaccacacccagctaattttttgtatttttagtggagatggggttttgccatgttaggcaggctggtctcgaactcctgacctcagggtgatccatctgcctcggtctcccaaagtgctgggattacaggcgtgaagcttgtgcccggcccacacttacttattctaaaaagaatttcaagatatgacaaggaactgatagagtgtgaacgatcttaaactctagaaatcccctaaaataaattgaggagtaaaagagtaagattctggatcagttaaagtagattgtttcttcaaggatgtaggtaatacatcatttagcataagccaaaagctgcaattttgaggtgtcattagcatactttggtctttaaaagtctgctctcattgtatatatcaacagtagagtaagatagttttcccttttaacacttaaaacataccatgctctaatgccttgtggatcacggacaaccctctttgcacaagctacagcatcagcgatgttatcttgcagcaaagctgaaagacaggtggtaaggaataaaaactttaatagatattttattttaaatttaggtttagccagcttttttctgttaggctgtggaaacaatggtaagatattattttctatgagtccatatatgtgtaattgttggggaaaacctctcttcattctctcccattcagcatgaaatgaagcattttttttcttcatttaccaaagtcattggaagctctggaagtattaacaaaatgattaaaggttcttctttgcactagacactgtaaaaaaacacctagtgatattttactcagcagttctattattgaaaatttatccaaaagaaataagaaatgcacccaaagatgtatacaaaaagctattcatagcaatttatgagggaaaaatggaaacaacctaagtgctcaatagtaacaattggatcagtaaattatagaatattcatatattaaaattctagtcattcttttaaaatgatgatacagatttgtatttttttttctcatctggaaatggagcaaaagatcattaaaaaccgatttgtatttgctgacatgcaaataatttttgtgtgataagaagcaaattgtaaagccgtgtgtataatacaatttaatttttgcaaaagcacacagtatttacatgtttgtatgtgggtttatatgtgtatgatataatttaacattcatacacatgattgatatacattctggaagaatatataccagaatttacccatggttataaacctctgggtaggtaagattatgggtgttatttttcttatttgtattttctaatttttatttaatgaccaaatattattatataatataaatttttttaattaactggattttagaaataagattaatgttctttattgggaattttaatatttaacaatttaataatatcaactttgcaagatttctgcaatatttttgacactgaggattccacatggtatttctatttttatgagttcagtaaaatatttgtttcactccaaataaataaatccttaaggttaatttgttatttacaataataattctacaggaactgtattttttgaagatgtaaactaaagaatttagaaatggaatatcatcatgttcctaattcacttaaaagtctctcagcagtagccaggtacagtggctaacgcctgtaattccagcacttaaggaggctgaggtgggaagattgcttgaactcaggagttcaagaccagcctgggcaacacagaatttgcctgtactaaaaatttcaaaaatttgccaggcatggtggtgcacacctgtagtcccagctacttgggaggctgtggtgggatgatcacttgaggctgcagtgagctgtgatggtgccactgcactacagcctggggacagggagaccctgtctcaaaataaaacaaaacaaaaccaaacaaaaaactctcagcaaaaaaaaaaaaaaaaaaaaaaaaaaaaaaggcatagaagaagcaactatggcaaaatgttaacaacttttaaagtgcataatgggcatatggctgtttattatactaatgtctctaattttctatacatttagaacatttcataaaaaaaaaaagtaaaacaattgaaaaggaccatacaacctaaattatcccaaacctcccaagtaagcaggagcaatggcattgttctggacaaagcatcagtaaggccattgacagtaaattaataggtcattccagaaacttctgtatattaaaaaacatcaaccttttatgataccacttctttaatttcttactcagggaattatgaggaaaataataatgactttctggaagttgagatgtagtttttctaggtccctcatgaacctttcaaggctttttcatttgtattgagtctcaattcttgtaagtataaccagattggtcaaatattagcttgtcttaccactgcaggataaatgacaggcattaactgctcctggggttttgccatcattacaccagtagcggctattgatctgaaatatcccataatcagtgcttctgtctccagcattgtagtttgtagctcgtgtgttgtaaccactctcccatttggccaaacacatccctgaaaagaacttatttttagtaataaacagcaacactaagtgacttatacctatagcaaaatcagttctacttagctacttctattttactgatttgttttataagtataaagatttacttataaaatatcttagcactttagtgttaagataagggacttgtaagagaatccttttgtaatgcaaatcatcttgtaacaccaacgaacaatataacatacttttaaaatattaaaatacatgtttgttccattgcttttacccttccgtgctcccatccctcagggcaaccattcagccaagaacagaaaaatcaacagagctgttgagtagattttgtaaattcatagcagatacataggctgatggaaaaatgctttttttaatcagaaaaacataaggattttctgatagaaattttcttataatatctaaaggtgaatttggatatcaagttagaatcttgaaaacaagactattccgtgatttcatcccttcactcattcattcaaaaatagctattgaggggaaatgtctgaattcaatctgaaaactacagagattattacatcgacaactatgtactaaactataaataactttcctcatggcacatcttgaattgtgtgggagaaatgaaagatagttaatcaagtaggtagataaaaataataaaacatttcatgctgagtttctgggatcctatacaaagagtgactgaagggaactaggttcctactgctcttgtgtagggaattcaatatattcttaaaaacatcactgttaaaaatcccatgtcggctgggtgcagtggttcacacctgtaatcctaccactttgggaggctgaggtgggcagatcatttgaggccaggagttcaagaccagcttggccaacatggtgaaaccccatctgtactgaaaatacaaaaaattagctgggtgtggtggtacacacctgtagtcacagctactcagaaggctgaagcacgagaatcacttgagcccagaaggcagaggttgcagtgagctgagatcatgccactgcactccagcctgggccacacagtgagactgtctttaaaaataaaataaaataaaataaaaataaaaataaaaatcccacatcacggcaggggacttgaagacaagaaaatactgatcactctaggctctcagaccaagttcaaaatgggaaataactggagtcacataccaaggacttgagagagagctctgccaggtcctcaaatgtatctttcagtcagcttacatgtgccattgaatctcaggcacccagcaaacttcctagcactagaacagtacaacaggtcctgttttacttagaatggaattttcccctgccatgcccgtattcctttatcgggtatctctggttataaagaaccaaactgatgtttttagccattgtaagtatacaaacccacaaagaaataaaacatctattcactcaaagccccttcttcttcttccttctctcctagtgtctgttccatacgtagctaattctctggaattatggagagtagacttacagtttgctaggctgattcccctgtagccatccattcccaatcttttcagagttctggccaactcacacctttcaaagaccttgccctggaccgtaacagaaaggaggacaagccccagaacaatgagagccttcatgttgactgctaggtcagagtgctaggctgaccagggtgagctggccccagtatttaacatcttttaacttccttcttccccttgtggtttgggggctccaccctttcagttgtgtggaaaacaggaactgtctattgatccactgactctaaagagatttttttaatgcttgaagagagatatgctgatgtcctaagaattagtctacaggaaaataatgaaatggaattgtttaaagtactggctctggaagaattggggcatagcactacttccaagacaggaactttcttctgtttgattatgaatttgagcaattataaagaaaaaaa

SEQ ID NO: 4407 - DNA, 3055 bp, Homo sapiens
tttttttttttacagatgaatcttttatttcatgggtgctgggtatgtggtctttttaagacaaaaattctacagcatggttttactaagtcagattgagtaggtcgcatctctgtgtgccacacagaacttttagacaagagtagaggggaaaaggttctgcaattcctcacagtaaagtactcacacagtaaatccttaacgaaaactactgaactgtgagtatatgctttataatcttatgcacagaaatgtatctattagtacagaaagttggaaaacaccaagattaaaaacagtgctgtaggaaaaattcacaacagtaaacaaattttgctcactcattttcctacaaatcttcagtttattaattcaagagaaactatattaggaatattcggctgatacccctatttcaccacctcatctaagctacactgtattataccaagaatggtggcaattttttccccatctatacagcactccatctagtggcaagttttcaccagcaattttaaaagatagtggcccaactctggtaacaaatagtggacactgatggtttgtcaaataagcaaatgcatttatttgatacacaaattccatgccaccagtcaaactatggtctggcttttttttttaaccaacagtaaagaaaactttttgggtttttttgtttcttttttgagatggagtctcacccttgccacccaggcagtagtagcacgatctcgactcactgcaacctctgcctcctgggttcaggcagttctcctgcttcagcctcccaagtagctgagattacaggcacccaccatcacgcctggctaattttggtatttttagtagagacggggtttcaccatgttggccaggagttcaagaaaagttttttaaaaataataaacctctaaagtgttaccctaactgtaccttacagtgatatatgacttctctagtcactccacattatccagtgatggcacctagataataatgcaccaaagaaaagtaaagaattgcagacttctagaagcaatgatgaaatataattctcagttgcagaaaatgatgatctgggtcattatgcaaatgcattcctgcctgtttttcttccaagttcttgcatggagcccaacacatccgatagcatggaagtggaagttaaactcccgatgaataatttttataaaattataaagaaaacaactaataacatgtatgaaattcacattaaatttagaagtggatagtaaagattaggactatatttcctttggggtgctgcttgtaggaaattactgaatgacaactgctatcacctgtgatttcatatccttttagctgatattgctaaagagcttcccaaactttttcaagtcatggcatacacaagaaatgatatctgtacatacacgggtaaaaaaatgcaagagattgctctcagctggatcccaagggctaaagagataaatatcttgctcacaatcaatgggaacctgtgaactaaagagtcaaatgtatgaaagtcctcatggaaaaatgctgacaagcactaaaatcactgtaaattccttggagagttctcagaattgcagaagttcagaaaaattactttggtcttttacatgtcaatattcaggaaagaggttctttctcttacttaacattcctccagggtgtgagaccctggtcaaggaaaacaatgattcctgtgtcttagtaagtcaaaccaacatggcagggtcaagttgacctccctggccactcaggccaaagccatacagtggaacagtgtgttctttaacctcgtaggacaactctcatatgcctgggcactatttttaggttactaccttggctgcccttctttaagaaaaaaaaaagagaaaaaaagaacttttccacaagtctctctcctctagttggaaaattagagaaatcatgtttttaattttgtgttatttcagatcacaaattcaaacacttgtaaacattaagcttctgttcaatcccctgggaagaggattcattctgatatttacggttcaaaagaagttgtaatattgtgcttggaacacagagaaccagttattaacttcctactactattatataataaataataacagctcggcccaggttactgtgacctctgacagatcaaggaaacaagttattttctcctcttgtgattacagcacattgcaagacatttttttccttttaataaacgtcctagtactcttttttttccctttcaattcatttaatttcaacaatctgtcaaaaaacagccaataaacaaatactgaattacattctgctgggttttttaaaggctctagactataaaaacatcttgtgtctcccaccctgaccaccctgctacttttccatataccacaggccacccatagacacaaagccagggggtgaagctgacatggtctatttggagccagtagacaggagggcgatgagtcctgatgaagcacttatggacaatatgtagttcactgtggggttgaagttcttcaatatgaagaaggaagcaacaatgaccacgaccaggaacagagtgttgttatagaagatggaaaatgttgtagcttcataatcagcaacttcattcttcttccacaagattctttcatctttctccttccgagacatctttctattatcagcttcagaaagttttcgagtcacttctttggaaacagcatcctccctcttctgtgctactttgtgcttgagaacaaatttcacattcttgtatgcaaaggctaccaaatatgtgcttactagggtcatcacactatacaaaacagcagactgaataagatccatatgccatattcgccagtataaccagatggggatggcagacacgatgaacgcgtttccgaagaagagcgcggaggacttggccgagagattgcggctgaaattctgcaggagcaggtcctcctcagactgctgtttggagctgcctttaggagccatggcggagctgcaggcgagaacagggaacgtagagccggccgcc

SEQ ID NO: 4408 - DNA, 2233 bp, Homo sapiens
ctgcagcctcaacctcctgggttcaggtgatcctctgaccctcaacctcccgagtagctgggactacaagcacatttttaaatttttttttatttttagtaaatatagggttttgccatgttgcccaggctggtctccaactcctggtctcaagcagtcctcctgcctcggcctcccatagtgctggaaatacaggcatgagccactgcgcccagccaagactaactcttttaattggtttctgtctctttgggtcctgaaaatctgtctcactatttattattattattattattattattatttgagacagagtctcactctctttcccaggctggagtgcaatggcacaatctcggctcactgcaacctccgcctcctcggttcaagcgattctcctgcctcagcatcccaggtagctgggattataggcacccaccaccacacccaactaatttttctatttttcgtagagacggggtttcaccatgctggccaggctggtctcgaactcctgacctcaggtgatcagcctgccttgggctttcaaagtgctgggattacaggcatgagccaccgcagctggccattttttttttctttcttttttttttttttttttttgagacagagtctcactctgttgcccaggctggagtgcagtggtgtgatctcagttcaccacaacctccgcctcccgggttcaagtaattctcctgcctcagcctcccaagtagctggaattataggcgcaccaccacgcccagctaattttgtatttttagtagagacggagtttcaccatgttggccaggctggtcttgaacgcctgacctcaggtgatccacccacctcagcctcccaaagtgctgggattacaggcatgagccactgcacctggccctatttattactgaagaatcaaaattaggcctagcctgaaaaatgagattattcttgatttttgaacagggtccttgaactgtcatttaaaaccaaatctggtaatctttagaggccactgatgaaaaataagggtaactacaaagtgatgacacttgtgtggctcagaatctgtcctcttaggcagatacagaagtgcagttctttttgagttctggtagcattgttttaaaagctgtgcacagcctcctgagattgctattttcaaaggtagcatttagttgatatatgtttgggtaggttttatttttaaatgctgttgctttctaatgaccccttatgttctaatatggaaaggggaggcaaagtattgtgaaaagtagttggtaaagtaggccggatgtggtggctcacacctgtaatcccagcactttggaaggccgaggcgggcggatcacgaggtcaagagatccagaccatcctggccacatggtgaaaccctgtctctactaaaaacacaaaaattagctgggcatggtggtacatgcctgtagtcccagctacctgggaggctgaggcaggagaattgcttgaacccgggaggcagagattgcaatgaactgagattgcgccactgcactccagcctggtgacagggtaagactccatctcaaaaaaaaaaaaaaaaaggtagttggtaaagttgttcacatgaaccttatttattatagtaaaacactgatttataataataaaaaatttgctattgtaacaaaaagagtctagagtaagaaactagctgagcaacgtggtgtcacactatacacccattaagacaacaggcacatgtgtcatgtccattttgtggaaaagatatgtaaaataattttaagtaaaaaagataaatataaaaaagtgaatgcatacaaaacaatttcacaaaattgaatgttactcaaaaatcacagctcattttaagctgcacaaaatagtcatttttttctttataattgctcaaattcataatcaaacagaagaaagttcctgtcttggaagtagtgctatgccccaattcttccagagccagtactttaaacaattccatttcattattttcctgtagactaattcttaggacatcagcatatctctcttcaagcattaaaaaaatctctttagagtcagtggatcaatagacagttcctgttttccacacaactgaaagggtggagcccccaaaccacaaggggaagaaggaagttaaaagatgttaaatactggggccagctcaccctggtcagcctagcactctgacctagcagtcaacatg

SEQ ID NO: 4409 - DNA, 2105 bp, Homo sapiens
ttttttttttttttttttttttttttttaacatgtgtcaaaagattttattaaactaattcaatttgttagggaaatggtaagatgttacaactggttaagaggagcattaaaagtgcagacatatattcaggccatcaagaatgaggaaatgaatttgctaaattgatgcaacatcaatcaatagccagggcctgtcattcacagacaatcactccaccacacgcacacatacattcctacggtttgtccacaacttccagagctgaagagtagctcaaggacatcaaagggcagaggcccctaggaagggctgagccacaatgaagcagtgctccttcactcccgatttccatggctaccaccgtttttctctggcaaatcagagacgaattttaaagactgagtaaatctataaaagcgattaatcacagaagttcaatgtctgataaattattccaaaagtgttcctgggcactgagactcaccaagcatacattctgaaatcaaattctatttctatccaaaaagtgcagcccatcagtgttcttaaaggaggcaaatggttgttgtgaggtagcaaacattttccaatgcaggtaaggatgtagataccaggtaaatgttacagttgtgttcatactaacaataaactatggatgacgtggcacagagtcagtcaatgaggaaagatccagagacattctgaggtcacaaaaagaatttaaatgttagctaacaaggagtgctcatcaaaaacaggactttcccactcagactgcaaaccaggcagaactaccatctcgctttatcagttgtcattgcatgttgacatcaacactgaggagagtgatgcagacgatagatataaacatatctacatacatatgcatacataaagcatatacttatatgcatacacagtttacatttcccagccagtgttcagaaaaactagaagagagaagtgatgttccattttgtcttggaaaagtatatattttacatatacatgcatgcatatgtctacatacatatgcatgtaatgcctacctgcatattaccaaactgatacacacgtgtatatatggaggtgtgtgtgtatatacatgtacattcactttatcacatactccatcagcttgacttctgagatggtaattcaagtttcatctttgttctgggcttcgtttctgtctctactgtattttttgtctcaaccgtcaagtcacattttatcaacacgttagactgggacaaaccaacatgggatggaaactccaatctcaggaggctaaaatcacagcgcaggttgggattgaagagttgctgatttcctttccctttcccccagcagtgtggaccatgagagtgggctgggggcggaagactgaggccctccctctcactcataggagggcaaaccaaacagctcgggctggaagtcctgcagggaattcagcaccagggtggcctttgttgtcagatctcggctcaagtttccgtcaggaaccatgaccgcctgcatcccagctgccagggccgcctccaccccattgggagcatcttcaaagacaaggcacttctccatagcaggagggggagagaacctcttggcacaagctaggaagatgtctgggtctggcttgccatgctgcacttcggggtcatctcccagcacaatgtgggaaaacaagctgaagaactccttgtggcggcttgtcttcatatcgaacgacgcggaccccgagctggtggctagtgcaaaggggatgccatgtttccgcaggtggatgatgagtttctccgcccctggcatgagcgcagccatggggaacacttcctttaacttcgtttggctttcttccaccagctcctctttggacatcgggagctgcaagacgtctattataatctgtgccgcctctaatgccttcttacccataaccagggactttacatcccagctgtatttcttgtcatagcgattacatatttcttgaaacaccactgaatacagccgttcagtatccagaagaagtccgtccatgtcaaagatgaggtgggtgacgggctgcgggggcgccgccatggtggcgccttctg

SEQ ID NO: 4410 - DNA, 1495 bp, Homo sapiens
tttttttttttgtgttgcaaagcctttaattagaatgtttgtattttttacatcatgcataacttcacatttgtgattaattagtaattatttcaatacttgtaagctcatctgcctcagatttaatcataatacatgaattaaattaatcaaattaaggaacagcaatttagaaagaaacacactttaagaaatcaaaattctcaattcaggcagtctgtttctatcatttggtattctactcctttaaaaatttcatattgcccaacaaaaagtggttatttttactgtttttggagatgactgaacagatgaaggcatcagatgccttcatcagctggtattttgcctaagatctatttaagataaccttttcttatattttttacttaatattgggcataatcgtatcattcaagattaagtctgggttatttctttgataagaactgaatgtggccgggcgcagtggctcacgcctgtaatcccagcactttgggaggccgaggtgggtggatcacaaggtcaggagatcgagaccatcctggctaacacggtgaaaccctgtctctactaaaaatacaaaaaattagccgggcgtggtggcgggcgcccgtaatcccagctactcgggaggctgaggcaggagaatggcgtgaacccgggaggtggaggttgcagtgagccgagattgcgccactgcactccagcctgggcgacagagcgagactgtctcaaaaaaaaaaaaaaaaaaaaaagaacggaatgtactggagatgtatttgataaccaaggttttaggtaaattttcaccagtattagttctatttgcaaactgaaaaatgttgtaggcttaatataaaataaccacattagtgaacattatatctcttagaagaaaggccatattttgctcctgcttctgtaaaaatattatttgtttgaaggggaaataatggtagtgtgacctttcacttaattcctactcccttaatgtgagagagacaaaatgagctgaagaaggaaaattctggagttacactccacaaccttgaacatactgacggacatctctgttttgacaacgatttctccatgccacccatgctctaatgccttgtggatcacggacaaccctctttgcacaagctacagcatcagcgatgttatcttgcagcaaagcactgcaggataaatgacaggcattaactgctcctggggttttgccatcattacaccagtagcggctattgatctgaaatatcccataatcagtgcttctgtctccagcattgtagtttgtagctcgtgtgttgtaaccactctcccatttggccaaacacatccagtttgctaggctgattcccctgtagccatccattcccaatcttttcagagttctggccaactcacacctttcaaagaccttgccctggaccgtaacagaaaggaggacaagccccagaacaatgagagccttcatgttgactgctag

SEQ ID NO: 4411 - DNA, 1316 bp, Homo sapiens
caataaatctgattgatttttattacacatcttagtttagaatcacttttacattcctagacaaagagatgatacaaataaatatcaattgtaaaacttagagccccaagtattgattggcgtattctttgtctaaaggtagccaaagagaaggtcaagatcagtaataacttcaaggagccatgaagcccactgcctcctgcctgccccaggatcactcctttcataaataaccccagaagcatttcattcaggaaacaagggcaggcagaaaggtgacagatttctgaacagtacaaaacaaagccttgcgtgatagacaatcaccaggcccactattcttagccagttccctcagagcatttttagtatggcttttagagtatattaacagccccattttcgtccactgatggggttcagatggtctgaggtgttgtctccagtacgcctcaacctcaagtgggaaatgtgaggcagaactgatatccatgttaacagggaatcgacacttctcagaaacttggcaacgattctacattcagtgagggaggacttgtcagagtcagacaggaaaagcagagagcggcccacgccccagttgcagcactctggcgcccttggtcatggaggtgtgggtggagcaattcaagcagcatgcaggcattggacgggaaataatccagcgttaggtcagtcttaagaaagtgtctcatgccatgatttgtggcccttgggttctgaaatcccggggtctgagaagacatgtgacttgaaaactatgaagcccagataacattctcccagatccagagttaaaagggggtcctattgggggttgccatacacagtctcaaactccttctcctgatggtcatcttagatcctgttagacttgctttctggctttgctagctgctgccggcatgaaggccctcagacggctcagaacattctaggtatgactagagacatgaaaacctagtccctcagtgggcttggtaggtcctctacatatttggctcaatgcagaacccaaaacagcagctttctggtgacagcacgacattctacaatctgctctattcaaatatttatcggatccattttgagagaagaaaagcaccagagactgcttggaaagggacagcttcatttccaaatgagtcttcttttctttccacagaccaccacatgaacacagctgagtacaaggcatgcctgtcaacttgtctgtcttctcttagaaaagttctatgtgtcacttaaccacccttggtcagaagagtcacctcgagataccagtattaatgtat

SEQ ID NO: 4412 - DNA, 1496 bp, Homo sapiens
  misc_feature (1)...(1496): n = A,T,C or G
aaaaacaccccggccccagggcggnctatttttnccccctaaaaaanaatttaaaangggccngaccanccccgganccaaaacacctaaaccacccaattaattataaatttaaaaagggcccaacctcccccccaaaaggcccgccattttaggaataattttaaaaccttagtaagaagctgtagaacaattttggttattttaaatttcctaccttatgccttaatgcatttaattttttttttaggaactacagtgttatctgtcattttcatgcgaatttttttcattaatttgtgactttacatagactatttcttaaattataggtacaccaatagctggtgctggggaaggatgtttaagcaacatgctttctcttctctgcagactctaaaatagcattgccagtgcacgacattcataatttaaaatgtatgcagagcactgaaatgtataaaaagcagaatataagaaaataaaatttattaaaattatttatattaaaaaatgaagtatatgaagatctctcagtaataaaagtacaaaaagctactctttgcaatatgaaaaattgaggtattgcataaagagatatcccgtcagtgaaaagtgtgcctaaaaatgttcactgttggaaaaacaagatatacaaaagtagtgcataacaaatatacattatgtgcatgacaaaataagttagctacaaaaacactgtaccgaaattcagcaggtcatgtacaaagggaaaaattattattcaaagctagttctcaaacagtgttatttcttgttaactcatcacacctgtttactgagtaggaacagcacgatagcacaccccaagccacctacaagcatttaaaagagtaaaaagaggcaaatgaacattccaattagaatcatgtagttcaggagaaaagaaaaaaaagtccctgaccagctacacaagagcaccctccattcccatgactgctttcagtatttgcagggaattctttaaaagcagctccctttctatgtttgaatattagacagcaaatgcctccattttgacctttggaacttaacaggtatagttcattaaagcctgtattaaaagtaaagggctgcttttcctaaagatcatccataggggtcataagccaggtggttccacagcagtgctggggcaagtcctttggttttgaaggatccaagatggtactgttaggtagcgcaactagcaagattgcccattcgatcatattatttcatgttttgcccactgataataatccttttaatgatggatagggcatttaataagagaatgtcaattaaaataaaagttacttccatgactagggcttcaagagactattttaaatttacccctgaagcatactgttcaacacataacgcctttcaaagctagaattttatttataataaagcatgcattacttgatgaagttggcacttcaaacactgactatgtcccatgctaaatt

SEQ ID NO: 4413 - DNA, 722 bp, Homo sapiens
  misc_feature (1)...(722): n = A,T,C or G
acacgttggatggtttctgatattttattacatcataatcaccaattgttaaaatcttggctgcacattcctggataacatctttaataaattaataagagaagactgattcttgcccaaaagctcaacttaacagcagcttgaaacactattaagatacactggaatgaacctatttaactgcattggccatccacccaacccccagagcccaaaaataacaggtacaggggcttattatttcagaagctatcaaaaatgacaggtttgctttggctctttggagcttttttttaaggaggcaaggacacagattcccatagactactttgtaatactttatcatacagtcataattcataaacttaaaagaatcttaaaccaatagctgttattttaaatgtccagaaagttatctaaagtcagcactatttaatggactgactcccagagcagtttttctttccactaaaatatccagacaagtcaaaaccaaaatgaactactgtttcttgacttctaaaaaagataatcaaccttgaaaaggatacanctgtgggttaagttcttcaatatgaagaaggaagcaacaatgaccacgaccaggaacagagtgtgttatagaagatggnanatgttgtagcttcataatcagcaacttcatttctcttccacaagatnctntcatctttctccttccgagacatctttctattatcagc

SEQ ID NO: 4414 - DNA, 496 bp, Homo sapiens
cgtcgaaactttttttttttttttttttaagaagcaaagtttaatcatacttattaagcaagacttttcacaagaattgagtataaattcaatctccatatttcagttaacttcaaaccttgtttcaaattatcctttccaagtttcaataatatggcaaataggacaaccagtaaacttttattgcttaagaatatcaatctaggccgggcgcggtggctcacgcctgtaattccagcactttgggaggattacaggcatgagtcaccatacccggccggttatctgcagttttcaattctcagatttgctacatgaatatttttagcctacagaattcagattagctttgaggaaatgtggtgtgagagacacgtgtaaccagcagaaaatcagcttaggctacccaccttagcgttttgttcttattcaaacaggcaaattcttagtaaataagaaagaagtaaagtttgatctcaagaaaatatgagggaag

SEQ ID NO: 4415 - DNA, 762 bp, Homo sapiens
  misc_feature (1)...(762): n = A,T,C or G
atttntctgttgnagagtacagncacgaggtgcgccntcaaatgnntnctaacccataaccagggacttaacatccnagctgtatttcttgtnanagcgatnacatatntnttnaaacaccactgaatacagccgttnagnattggaggcggcggctgcacacnacccacccagaagaagtccgtccatgtnaaagatgaggtgggtgacgggctgcgggngcgccgccatggtganctcgtgccgaattcggnagaggttntctagttgcttgtgttctccttncctaggatgccacagtgataccacacctcatggaactgnttagcaggtcccgatatanccagggngtacaatctgtaagatcttntaanaantggctgtaaaagggccaagatcattaancaatttaattttaaccaaggtgaagttaaagaatattngatnaacaaanataaacnttaanntnncnctntaaaaaggtaaagnttnnaaaaaanattttttngaaaagtntnannaggnnaaggcagnntagnaattnngantnncagntngtnacnggggggntattnnaaatnnggtnctcnaatggttaannnttgnngaaananaaangncngctggtnggnnnttcctatanggcnggngtccngnaaaagngnnntnncctagntttngaatttnaancttgtannaatgacangntttcntngnnnaaananggggntaaaannnnatngggngttnatttaggntntg

SEQ ID NO: 4416 - DNA, 635 bp, Homo sapiens
ttttcaggattttatttatttatttgtttttttgaggcagagtcttgctcagtcacccaggctgtctcaaaaaaaaaaagaacggaatgtactggagatgtatttgataaccaaggttttaggtaaattttcaccagtattagttctatttgcaaactgaaaaatgttgtaggcttaatgtaaaataaccacattagtgaacattatatctcttagaagaaaggccatattttgctcctgcttctgtaaaaatattatttgtttgaaggggaaataatggtagtgtgacctttcacttaattcctactcccttaatgtgagagagacaaaatgagctgaagaaggaaaaattctggagttacactccacaaccttgaacatactgacggacatctctgttttgacaacgatttctccatgccacccatgctctaatgccttgtggatcacggacaaccctctttgcacaagctacagcatcagcgatgttatcttgcagcaaagcactgcaggataaatgaacaggcattaactgctctggggttttgccatcattacaccagtagcggctattgatacgaaatatcccataatacagtgcttctgtctccgcattgtagtttgtagctcgtgtg

SEQ ID NO: 4417 - DNA, 835 bp, Homo sapiens
  misc_feature (1)...(835): n = A,T,C or G
tcatcaatcngacccnanttnnantccngganaattnnaggtattcncaacaanggnatcnccngganntntntacatantggncccncaancnatgnnncangggnggngaaatccnncagntaacccacaacngnnggngnanttnncncatgntctcacanntgtggcnaattgccacaantnnatgttaccctnannnanacncntttgncccccnaaattcaagnnnaggncnatggtncnnanagggggcaancntttnttaaanncaaaanccttaggncctntaaaatatggtggancacatccnnttggttaacctccaatcnacctncccttgtnttacttnnggtaggnanaagncacggattngctacacacnccaaancncaccctnaaaaagnaattttaaaangagtaaaaatagtggcaanttgaaccattccnattngaatcnntgtagttcagnaganaagnaaaaacaggtccctgaccagctacacnagagcaccctccattcccatggactgctttccagtatttgcagggaattctttaaaaagcagctccctttctaatgtttgnatattagacagcaaatgcctccattttgacctttggaacttaacaggtatagtncattcaaagcctgtattaaaagtaaagggctgcttttcctaaagatcatccataggggtcataanccaggtggttccacagcagtgctggggcaagtctttggttttgaagganccaagatggtactgttaggtagcgcaactagcaagattgccantcgatcatattatttcatgttttctcgtccgaattc

SEQ ID NO: 4418 - DNA, 413 bp, Homo sapiens
tcacccttgccacccaggcagtagtagcacgatctcgactcaccgcaacctccgcctcctgggctcaggcagttctcctgcttcagcctcccaagtagctgagactacaggcgtgaacctgggaggcggagctcgcagtgagccaagatagagccactgtactccagcctgggtgacagagcgagacgctgtctcaaaaaaaaaaaaaaaaaaaaagaatatcaatccaagatttttattaagttaaaatgaaggaactaaaaataggtaaatgaaaatgttataacactttagtgctatttatgagtatgaacaatggaatttaatcactttgaatcccaattacagatgaatcttttatttcatgggtgctgggtatgtggtctttttaagacaaaaattctacagcatgg

SEQ ID NO: 4419 - DNA, 410 bp, Homo sapiens
ttttttaacatgtgtcaaaagattttattaaactaattcaatttgttagggaaatggtaagatgttacaactggttaagaggagcattaaaagtgcagacatatattcaggccatcaagaatgaggaaatgaatttgctaaattgatgcaacatcaatcaatagccagggcctgtcattcacagacaatcactccaccacacgcacacatacattcctacggtttgtccacaacttccagagctgaagagtagctcgtgtgttgtaaccactctcccatttggccaaacacatccagtttgctaggctgattcccctgtagccatccattcccaatcttttcagagttctggccaactcacacctttcaaagaccttgccctggaccgtaacagaaaggaggacaagccc

SEQ ID NO: 4420 - DNA, 423 bp, Homo sapiens
gacttaagaagcaaagtttagtcatacttattaagcaagacttttcacaagaatcgagtataaattcaatctccatatttcagttaacttcaaaccttgtttcaagttatcctttccaagtttcaataatatggcaaataggacaaccagtaaacttttattgcttaagaatatcaatctaggccgggcgcggtggctcacgcctgtaattccagcactttgggaggccgaggcaggtggatcacgaggtcaggagatcgagaccatcctggccaacagggtgaaaccccgtctctactaaaaacacaaaaaaactagccgggcgtggtggcgggcgcctgcagtcccagccactcggcaggctgaggcaggagaatggcgtgaacctgggaggcggagctcgcagtgagccaagatagagcc

SEQ ID NO: 4421 - DNA, 540 bp, Homo sapiens
  misc_feature (1)...(540): n = A,T,C or G
ctgggctgcaggaattctggcacgaggtgcgccttcnaattggnttctaacccataaccagggacttnacatcccagctgtatttcttgtnatagcgattacatatttnttgaaacaccactgaatacagccgttnagtattggaggcggcggctgcacactacccacccagaagaagtccgtccatgtnaaagatgaggtgggtgacgggctgcgggggcgccgccatggtgnnctcgtnccgaattcggcagagatnttctntttgctgttttctccttccctaggatgncacantnataccacacctnatggcactgcttagcaggtcccgntatanccaggngtacatctgnaagnncttttnanactgctgtaaagggncagancatcaaacatttcnntttnaccannggtgcagttcagattnttggttnnntcttcntaaccgnantgtccnaccaaagtntgncngntaaaattttgtggaaagttggatnnggatgncggtncgatttggtntgatagccggcacggggn

SEQ ID NO: 4422 - DNA, 495 bp, Homo sapiens
  misc_feature (1)...(495): n = A,T,C or G
atgtgtcaaaagattttattaaactaattcaatttgttagggaaatggtaagatgttacaactggttaagaggagcattaaaagtgcagacatatattcaggccatcaagaatgaggaaatgaatttgctaaattgatgcaacatcaatcaatagccagggcctgtcattcacagacaatcactccaccacacgcacacatacattcctacagtttgtccacaacttccagagctgaagagtagctcaaggacatcaaagggcagaggccctagggaagggctgagccacaatgaaggcagtgctccttcactcccgatttccatgggctaccaccgtttttctctgggcaaatcagagacggnttttaaaggactgaggtaaatcttttaaaaggcggtttaatcacngggagtttcattgtnctggttaattttttcccaaagtttttncgggggccntgaggtttccccnggcttnctttttggattccatt

SEQ ID NO: 4423 - DNA, 360 bp, Homo sapiens
  misc_feature (1)...(360): n = A,T,C or G
ttgtccagaagtccagacgggaaaaagncaganagcggcccacgcccccagttgccagccactctggcgcccttggtncatggaggtgtgggtggagcaattcaagcagcatgcaggcattggacgggaaataatccagcgttaggtcagtcttaagaaagtgcttcatgcctatgatttgtggccttgggttctgaatccaggggtctgagagacatgtgacttgaaaatatgaagccagatacattctccagatcagagtaaaagggggtctattgggggttgcatacacagtctcaaactccttctcctgatggtcatcttagatcctgttagacttgctttctggctttgctagct

SEQ ID NO: 4424 - DNA, 393 bp, Homo sapiens
  misc_feature (1)...(393): n = A,T,C or G
tcccaaccccaacctgggncctcccccaaangtgccctaggantaacaggccnggagtccacccataccccggccnggttancctgcaagttttccaattccccagatttgcctacatgaaatatttttaagccctacagaattccagattagcctttgaggaaatgtggtgtgaagagacacgtgtaaccagcagaaaatccagcttaggctaccccaccttagcgttttgttccttattcaaacaggcaaattccttagtaaataagaaagaagtaaagtttgatctcaagaaaatatgagggaaataatccagcgttaggtcagtcttaagaaagtgcttcatgcctatgatttgtggccttgggttctgaatccaggggtctgagagac

SEQ ID NO: 4425 - DNA, 363 bp, Homo sapiens
taagaagcaaagtttaatcatacttattaagcaagacttttcacaagaattgagtataaattcaatctccatatttcagttaacttcaaaccttgtttcaaattatcctttccaagtttcaataatatggcaaataggacaaccagtaaacttttattgcttaagaatatcaatctaggccgggcgcgggggctcacgcctgtaattccagcactttgggaggccgaggcaggtggatcacgagattctttcatctttctccttccgagacatctttctattatcagcttcagaaagttttcgagtcacttctttggaaacagcatcctccctcttctgtgctactttgtgcttgagaacaaa

SEQ ID NO: 4426 - DNA, 322 bp, Homo sapiens
aagaagcaaaggtttaatcatacttattaagcaagacttttcgcaagaattgagtataaattcaatctccatatttcagttaacttcaaaccttgtttcaaattatcctttccaagtttcaataatatggcaaataggacaaccagtaaacttttattgcttaagaatatcaatctaggccgggcgcggtggcgggcgcctgcagtcccagccacctggcaggctgaggcaggagaacggcgtgaacccgggaggcggagctcgcagtgagccaagatagagccactgtactccagcctgggtgacagagcgaaactccgtc

SEQ ID NO: 4427 - DNA, 307 bp, Homo sapiens
  misc_feature (1)...(307): n = A,T,C or G
atccaaaactgatgagagacatcatccctcatatggttatgttttttgttgttgtttgatgaaagnaaaagcagtgacagggcaagggcctaaggaagggtacgggtatggtaccttgatcttggcgcccagcatctcggcagcatccttctcccgccgcaggtcctccatctttttctctttctccttcagcagcctcatcttctcctctgcaaccaagctgtgatcctctacaatggcccgcttctcaatctccagtttttcntgctgttcccgccagtaatcatccttatcatccccttcctcc

SEQ ID NO: 4428 - DNA, 307 bp, Homo sapiens
  misc_feature (1)...(307): n = A,T,C or G
aagaagaggctccgtgcctccccgagctcaggggagctggagagattgccgacccnccggccggcacccaacgccttccctgctcgccgggtcctgccacgtccccgcccagcccgactagccggcggcctgcctaacccgcctcgctcccagcactcacagatggggatggcagacacgatgaacgcgtttccgaagaagagcgcggaggacttggccgagagattgcggctgaaatcctgcaggagcaggtcctcctcagactgctgtttggagctgcctttaggagccatggcggagctgcagg

SEQ ID NO: 4429 - DNA, 531 bp, Homo sapiens
tttttaacatgtgtcaaaagattttattaaactaattcaatttgttagggaaatggtaagatgttacaactggttaagaggagcattaaaagtgcagacatatattcaggccatcaagaatgaggaaatgaatttgctaaattgatgcaacatcaatcaatagccagggcctgtcattcacagacaatcactccaccacacgcacacatacattcctacggtttgtccacaacttccagagctgaagagtatctcaaggacatcaaagggcagaggcccctatgaagaatgaagcaacaatgaccacgaccaggaacagagtgttgttatagaagatggaaaatgttgtagcttcataatcagcaacttcattcttcttccacaagattctttcatctttctccttccgagacatctttctattatcagcttcagacagtttcgagtcacttctttggaaacagcatccttcctcttctgtgctactttgtgcttgagaacacacttcaccatctttgttgcaaaggctac

SEQ ID NO: 4430 - DNA, 547 bp, Homo sapiens
  misc_feature (1)...(547): n = A,T,C or G
tttttttttttttttttgtttttttttgggattacagcacattgcaagacatttttttccttttaataaacgtcctagtactctgagtttccctttcaattcatttaatttcaacaatctgtcaaaaaacagccaataaacaaatactgaattacattctgctgggttttttaaaggctctagactataaaaacatcttgtgtctcccaccctgaccaccctgctacttttccatataccacaggccacccatagacacaaagccagggggtgaagctgacatggtctatttggagccagtagacaggagggcgatgagtcctgatgaagcacttatggacaattggtagttcactggggggttggaagttcttcaatatgaagagggaagcaacaatgaccacgacaggacaaagtggttggtattagaatagaaaaatggttgnagcttcataatagcaccttatttttttttcacaggaatcttttatcttttttccctccagaaaccttttttttatcagctaagaaaggtttncggggaccc

SEQ ID NO: 4431 - DNA, 457 bp, Homo sapiens
ccctttcaattcatttaatttcaacaatctgtcaaaaaacagccaataaacaaatactgaattacattctgctgggttttttaaaggctctagactataaaatcatcttgtgtctcccaccctgaccaccctgctacttttccatataccacaggccacccatagacacaaagcctcggggtgaagctgacatggtctatttggagccagtagacccgagggcgatgagtcctgatgaagcacttatggacaatatgtagttcctgtaagaaatttaatgttatggaaaaatgagtaactccaaattggttttttgagaaaataaagagcccatctctttggaatgtactgcttccttcctgacacttggtgtaatcataatgatgtgcagccccattgtctgcaaacacaatttgcaagacagaagaccaaaaggaaatggaaaacattcacagga

SEQ ID NO: 4432 - DNA, 399 bp, Homo sapiens
ggtttgtcaaataagcaaatgcatttatttgatacacaaattccatgccaccagtcaaactatggtctggcttttttttttaaccaacagtaaagaaaactttttgggtttttttgtttcttttttgagatggagtctcacccttgccacccaggcagtagtagcacgatagcacaccccaagccacctacaagcatttaaaagagtaaaaagaggcaaatgaacattccaattagaatcatgtagttcaggagaaaagaaaaaaaagtccctgaccagctacacaagagcaccctccattcgcatgactgctttcagtatttgcagggaattctttaaaagcagctccctttctatgtttgaatattagacagcaaatgcctccattttgacctttgg

SEQ ID NO: 4433 - DNA, 409 bp, Homo sapiens
cccaccctgaccaccctgctacttttccatataccacaggccacccatagacacaaagccagggggtgaagctgacatggtctatttggagccagtagacaggagggcgatgagtcctgatgaagcacttatggacaatatgtagttcactgtggggttgaagttcttcaatatgaagaaggaagcaacaatgacgggcttggctcacaccctcacatgtccctggcattctacacagctgaggctacagatgcggaaggtaagattacagtacttattttgcttgtcatctgtctcttccctcctcccacactggaatgtaatttctgaggaaagggaccgtctcctttgttcactgcaaaatcctcagtgcctaagagaaaacgctggtcagaagctaacccagaat

SEQ ID NO: 4434 - DNA, 286 bp, Homo sapiens
  misc_feature (1)...(286): n = A,T,C or G
cgatgagcccggaggaagccttagggacaatatgtagntccactgtggggttgaagtcctcaatatgaagaaggaagcaacaatgacaacgaccaggaacagagtgttgttatagaagatggaaaatgttgtagcttnataatcagcaacttcattcttcntccacaagantctttcatctttctccttccgagacatctttctattatcagcttcagaaagttttcgagtcacttctttggaaacagcatcctccctcttctgtgctactttgtgcttnagaaca

SEQ ID NO: 4435 - DNA, 226 bp, Homo sapiens
aatccctactcccttaatgtgagagagacaaaatgagctgaagaaggaaaattctgagttacactccacaaccttgaacatactgacggacatctctgttttgacaacgatttctccatgccacccatgctctaatgccttgtggccatccattcccaatcttttcagagttctggccaactcacacctttcaaagaccttgccctggaccgtaacagaaaggagg

SEQ ID NO: 4436 - DNA, 1827 bp, Homo sapiens
ttttttttttttttttttttttttttttttttttttttttttgaactcatttccagagtttattgcattatacatgcgaccagaacatgcacagaaaggacaggttgctgttgtacttctaccaaaccacagatgcaccacaagggaaaggctacaaggcataaatcgccaatatcccatctcaccaaggacaactgctaaattcatttgtgaaaagatacattgtaatgtgctttttaagcccccctccctccaacttgtgggttttcttaatcttttttttttaaatatatatgccatttttaaagtactggatgtattcaaaatgccatgagttcatggactaaccacacacatagaccttttgtgttaggaaagacatgaaaaagtcacattgctggatggatggatggatggatgctctacagttccaataagttaagacccaaatgaaaatgcgcaataatagttaccctgcattacgatgaaaaaataataaattacacgtgctaagtttttatatatatatatatatatatatatatatatatatatatatatatatactcatagggattacagatcacttgtagtacgaacataatgaccccaaagtcacattctagcaggaaaacacattacaacaaaacaacaaacaaagagcggtgaaggttgtgtttccgctttgccagtactacatcactgggccctggaacgcggcgccccctctccaatcctggcctctgatccggcctcagaccggcctcagacctaagaaaacgtgaggttggcggtcgggtctcggatccggttctctcggctcatcttcttgagtttcattcggcggttttgaaaccaaatcttgacctgcctgtcggtgaggttaacgctcttactgatctctaggcggcgctcgcgggtgaggtacatattgaacaagaactctttttctaattccagcgtttggtgcttagtgtaagggcacctcttctttctgccactctttgcagtgagccaattgctggttggtgtatcagacttgatttcctctttgctttccttctcctgcacttcgggactggacacggagacctcagccaggcagctcctctcttcgggaaggccgcctttggcctcggggctctccacctgggagactttggtgggctcctggccgctcacgggctcgttcatcttcttttccatctgcagctgggcagcggagagctgcggcttggccgcgccacgagggttgagctggagcatgacagtggagctgccttcggggctattattgtactcttgggttttcccggtggcgtaggtctgactcagtctaaaatatcgagggacgggaacctcagggttctcaacgggacaagactcagggaccagcctctggtacgaagggacctcggccgaaatgagtttgttgcgcttatcagaatacatgcagcaattggattcttccttaatgttggtggtgaaggagcaagtggggacttgctgtgtaacaggttgctctattcgacaagatctgttcggatctgtccaactgtctacttgaggtatataaggatgcacattcatacccatattttggtggttcacttctcttttggccagagacgggagcagtccacaggtttgcattccataggtccccatgtctgcgctaggtggtggcatgtacatgctggcgctgctggaataaaaactgtcactcctgcaggcactgatcaaggaatctactaaaaaagtattagcagcaggagagctgttgggaaaggacattttggggaaagaatttgaagaagagagattgtg

SEQ ID NO: 4437 - DNA, 573 bp, Homo sapiens
  misc_feature (1)...(573): n = A,T,C or G
aaatatatatgtcatttttaaagtactggatgtattcaaaatgccatgagttcatggactaaccacacacatagaccttttgtgttaggaaagacatgaaaaagtcacattgctggatggatggatggatggatgctctacagttccaataagttaagacccaaatgaaaatgcgcaataatagttaccctgcattacgatgaaaaaataataaattacacgtgctaagtttttatatatatatatatatatatatatatatactcatagggattacagatcacttgcagcacgaacataatgaccccaaagtcacattctagcaggaaaacaaaatacaacaaaacaacaaacaaagagcggtgaaggttttgtttccgctttcccagtcctccagcactgggccctggaacgcggtgccccctctccaatcctggcctctgaccggcctcagaccggcctcagacctaagaaaaccgtgaggntggcgggcagntcctcggatccggtctctcggctcatctttctgagttcatttcngcggtttgaaaccaatcttgccctgccctgcgg

SEQ ID NO: 4438 - DNA, 3024 bp, Homo sapiens
ttttttttttttttttttttttcctatgaaaatgtttttaattttcatcttttggaaatacatttttcatttttatttccaccatacaaaaatgtgaaatatctaacaatgatctatctgaagcgggtggagcaaagcagcgccatgagcgtttgtcgttgctgtgatctgtttcaacggagaatgggctgggacatgttgtagatttgcacgatttcacacacacacacacacacacacacacacacacacacacacagacacgtacgcacacacgctgccgtaccccgagaccgccatccaaacaaacgaacagagactctggaaagtgaacacagcgccacgcataagaacagaagttaacctttttactcgtacatcccccatgagaaactcacgtcttaggagaaaggaactctacataaatatgcccaaaggccagggcatacggcaagccctctcatgggtgggcatgagtggacatcttcctgaaggaaggacaagcttgagagcgtcatgttttcaggcagctatggtgggaagcagggaggcacaaccgatttttccactgggagactaaccgagggctgcaactgcctcaaaatctcagtgcgagaagatgcacaggcaggacagtacacccccaaattcatgatcacagcagctggaatgtcagctctttttgcagatttcacagccgacactccccatcaggcaggttcttaagcacactgggtcatgacaggaaaggcctcacaagagcaacacggaattcactggttaagcacgtacacattcatgacagcctacaaccgtgatgagtgtcaatgtcaacaggcagttagattaaaaaggggaaaaaaccacagccacaaaaataaaacctgttttctcccccccaggagacaacttggtttccaacccctcccataccacatttgattaagttaaatacagtgcggcttccaaatgtgccagccggctcttgctcacagcgacagcaccagcggtttgctgccctcaggtcttggttaccatgtgtcaggaacttcaaagagtgtggcagggctgttcttcgagatgcttcctgctggagaaagctccttcttcattctttttaatttcttggcctttttccttccctctgagaggggctctgcacaggaatcggtctgctcaagctcagtgtcggaaatctcccctgacactccgtcctccaggccagcttcctcttgactaggactcaaatttctctttcctactgtgctgggagctgtaaaactattgttgcggtaatagtgattctgcagggtgtagggtatgcactgggggtttaaccgtttgctgtcagcctccttccagctatcttcagtccactttcttttgatctgcttctcttcctgttttctccccatatattcagcataggtttggatccgatagctttctgcatatttgctggtattgacagcaatctttacttgctcgggctggctaagggaaacaaatgctgatgtgtcatcaatccaggatatctgaatgttaccaaaggcactgaaaagctggtaaaggtcgctggttttccattctttggggaatgtcacatggagaacatgatcacgtttaggctgcaagtctggtccttccaagtttagataggggatatccatgaccctcataagaaataacttgttaaaaaaaggttcaatgagttttgatctggcagacacatgaatttttggagggctgagaaaagaacctaggtaattggccatggagatgaagcacagccctgtgatgtaggcatcgtagcctgcctcgtggagttgttcagaggctgtgtcataacttggaaaaccttcggcactttcaactttaggagggttgaaaggtgtctcttttaaccgcttttccaattccgcaagggatgtgttgttaatgatatccttaaaaggttgtgtgctggccatcaatttagtatccaagagtctggggaaaacacatgttgtcatctctttaaactcacttaagtccgcaggcagagggcagtagaactgatgaactgtgtgcatgacgtccaagagcatattgtgtccaataacaagttttcccgaattagcaatggcgtgaatgactctagaaaatcccacagcatcattcagctcctcctgttctttggcatgtttctgctgctctcttcttttgcgttcttcttcatctactttgctgataactatatatcgctccttcttttcagtttctaaagtctcaacatgaatgcctttcggatacttccagctcaaagtctgataaattagttttctttggaacccggtacatggctctaaatccaagttcttgttttcttcactttgtaataaatcctctattttctctaccacttggtcaataaacttcttttgatcctcaggaatcgtgacaggacattttgaagtgttaggagatacataggacagagctcctgcaccattcgcctgtgaacgtttttcatcatactgctctcttaactgtctttcttcttcctgatttaaatatggaattccatttcgaaaaactttattaaaatcaaatccctggcttgctagaaagtcaatgctggagctctgacaaacaaatttgacatctggtgaggatctattgaagggtttcgggaaaacatagaagttaaatgacttcgttatatactttgaatctgtgtagtcatacttaaaagtgcaaaggccaaactgaaatagcaaaaagtccatggaatgctttttaagcttctgatacctctcttctggagtgtcaaaaccatttgttaatgcagagactgaaggtccatcactgattcctgaaaactccccatcgatggcgaagaagtcggcctcctctatggcctggtacactttgtgaagattactcttaaaattgctcctgattatctccattctgcagagtggccggaaccttggccccacccgggcccgcgcccgcctcagcggttctactcgccgaattccg

SEQ ID NO: 4439 - DNA, 651 bp, Homo sapiens
  misc_feature (1)...(651): n = A,T,C or G
cccatgaacatcaagccttagtggcttagcagattttttaagagtgtgaaatttatctgtgtattactagagagtgaaaacatcattcacttatttaaaaaaagagaggagaaaaccagagtcctatgaaaatgtctttaattttcatcttttggaaatacatttttcatttttatttccaccatacaaaaatgtgaaatatctaacaatgatctatctgaagcgggtggagtgaagcggcgccatgagtgtttgtcgttgctgtgatctgtttcaacagagaatgggctgggacatgtagatttgcacgatttcacacacacacacacacacacacaaacacacatacacacacacgctgccgtaccccgagaccgccatccaaacagactctggaaagtgaacacagcgccacgcataagaacagaagttaacctttttactcgtacatcccccatcagaaactcacgtcttaggagaaaggaactctacataaatatgcccaaaggactgcagagacagcgattctcgatcgaacggttacgattcggaattcgatatcaagcttatcgataccgtcgacctcgagggggggcccggtacccaattcgncctatagtgagtcgtattacgggcgctcactggccgtcg

SEQ ID NO: 4440 - DNA, 3988 bp, Homo sapiens
ttttttttttttttttttttttttttttctggagattttttttttaatcctttttagttcaacataaaatgagaaagaaaaaaatatttctgacattttcaaagaacagaaataggaaagtatgttcatatacattcaacgtatactgcacatattggttactacaatacaaagcaatgagttttttttaaagtgtagtttgcaagatggcacggttagtaggctcactggctttcatctgttgttgctggagggtgcagtctgctctcccatacatacagtaccatgtaaacacatcaggctgagcgcgtggtggtggtagggcaggttgggggcataagagttggaacaagcgcagataagtcaacagctttttagggctttcttggtaagcccccttctggtgagtagttggtgaccccaccaagtggaggggagactggggaccatggaaacatgggacagctcccacgaagggctcttgcactgcagaattccactcaagggatcttgggtccaggagccgagctgccagtatcagtggagaaggacaaggtgcatggggatcccgccagcaacatcaggatggccatgccgggcacccgctttcctctgtgcaaattcaggatgaaagactaggaggggactcgggacctcttgctctctctctgtttcttgttacacgcctgcctgctccatgctgaaggagacttcggggtgcttgtagctgagcagaatgtctgtaatacacgtagatggatagcaagaggagtttaaatgctggctgccatcactcaggtctgggtgctcatgacctcccaggcttgccccacattcctcattttccccatcctgaaactgctggctgcccatgagcgaagactgactgagaactgcatccgacatccgggcagagctaagtgctttcccagccacgagactcattcctggcaagttatccagctgtacataagcatcgtcgctgttctggatcgtgtggtgataagagtcagcattttgataagataaagcctggcgctctgtcatgctctgtcccccaaggctgggagccagactccccgcatccccttggttcatgtgcctgaacagttcctggtattcttgctgttgctgctgttgctgctgctgctgccgttgttgctgctgccttttaatgagctgtgcaaactctgttgggggcagccggatgtccgagtggccggtgagcgaatgccggggagaaagcagtccttgaaggatgtggggtacctgctggtgtcttgtatagtctggcggcgtgggagacagcagggcctgctgtagtgccgacgtggtatagtgtggcggctgctgatgtgcactgggagggaaggtggggaattggtcaagtggagggactttcagggcttgggttggagagaaccccactcctgttgaagggctgtagctgctgggggaaccccgggactggtccgaaaacagatgggggtgtaaatgcgcctggtcgtagttagcaggggagaaccgattcacgttcaagctgtgagcctctgcactgtcagcactcagctgcttggacaagggacggtgcccatagctgagggtggccatcaggttggtacggtgctgcatctgcatctgaccagcactggggctgatggagatgccgcgcccactggagcctgcagctgtgcctggcatgttgctgagcatgtcaacaggctcttggacttggatggtgacctgctgtgactgagcaggctgctgcatacccaagcaggttagtgccacgttgggaggagaggaacagttctcaggttgctgctgaaagattgcactgcgggaaggtaagccttgaaactgggaagaagatgcagccccgtgaggctggatcatggcactgctcatggggggaggactattactgggctgcctgaagagatggttgttggggtggttggggggtgggcttgaaggctgaatccttaacctctggagctgatgggtaaggagggctggctgattttcacatgcagcctgaagaggtggagatggctgaggaggacagatagagtcttgaatttgttgctggagaatttgatggtgctgctcctgctggtataacatatgctgctgctgggtcttctccagggttctttcatcaatctgccccccgtacatcttctgcagctgctcacactcctgctgcagctgtttgatgctgctgttgttgcccattttttccaggtgagctttgaaggcctggatgctcgcagccccatctgagaaccggcgcacaggggagaaacgctccgtagggaggtgcagagtgttggagtccttgtaggtagagctctgcacagcttcctggtctggctccccgtctgagctctcctcgtccacaggggtaactgctggcactgctggtgtcatggtgacaagcggagagggtccccgtgggcgcttcagcagctgctgggcatgcagttggatgttggctcctccatctgatgccctccggccaagggggcccattccattcaacagctgtagcgtgggcggctgtaggagagactgctccttgtactcaagttgcccggttggttgcaagttttgcataggcaacaggttgtgcatgaagttcacattaggggccacctgcaggaatggagcctgggggttgactccaggaaagccaggtaggagcttctgcagatcttccataacttccgtgcgtgggtcagccacacccactgtgtgcctcctcattgacaaatagcgcaccaatgcttcaggggaaggctcttcaccctcatcactgtccaaattcagtgtcccatccggctccacaatttggttctctgggttgatcagctgcacctggggaacgctgatgttcatagcagtacctgcctgctccgcctgcagtgtctgttctttgtccagtcccatgtcctccatggccaagaggacatcctcattcagggggtccacctgtctttcttcctttagttgttggcattcagctattaacctgtcaaagttgggatcggcgtcccctagcttcatccacttgtgcttgcagatctgctccatggagaggcgcttattgggatctaacaccaacatatggcggatcaaatgctcacattctgtggacataaaaaatgggatgcggaactttccactcagcacgcgggcccgcagattctgcagtgtgcttccatcaaatggcagggcaccgcacacaagcacgtagaggacaactccaaggctccagatgtccactttgggcccatcatattcttttccttcaaagagttcaggtgcagcatagggagggctgccacaccaggtcttcagcagctgcccaggagtgaagaggttactgaaaccaaaatctgctattttgatattcagattggcatccagaagtaaattttcagcttttaaatcacgatgaacaatgttccgacagtgacaaaaatagacagctgtgacgatctgtttgaacttccgacgtgcctccttttctgccattctaccatgggccaccaggtggtcaaatatttcccctccactagcatattctgtcaccagataaatcatccgttctgtctccataacctggtagagcctgatgatatgggggtggcaaagcatcttcataatttgaacttcccggaaaatcttcttcaagttttcttcatccagctgggtcttatctatgatcttgatagcaaccttggccttggtgacgaggtgcgtggcccgcttgaccaccgcgaagttgcccttgccgatggtgcggtcgatctcgtagtagccgatacgggcgggcatgggtccgcgggaggccggggctgggggacgcggctggccggccgcaggggacacggcagcgggggcggctggggaccccggcgcgggcggaggcagcaggcggcccgcgggcccggctcccccagtcccggccccggcagccccg

SEQ ID NO: 4441 - DNA, 2053 bp, Homo sapiens
agagaggcagggcccaaggcaacctcctacacttcttccctgtgacaaagaggctgaaagaggagagcatatatatatatattttatatatatattatatatataatatatatataatatatatattatatattatatatataatatatatatacacatatattatattatatatatacacacatatataatatatatatggagaaaccaatcctttttatagcacaatataaaatgagaatgaaagatgccatagaaagcatagtgcactgctgttgggtgttcagtccatggataaaaccagcaggatgataaaggcaaccaactttccaggttacaagaggggagctgagttatccaccaaaagcaaaggctcaaattgagacatcctaactggcaaaccatctatgccaggtcattctcagcctccgtgccaaactcttcatatgatcttggctaggacagacatgttttccgtggatcccagcagtaaagacctctctgcgttccaggcttgggggtttctctttttttgttctttttgttttctaagtgccagaagccgtcacccttcctctctccctttgcctgccattaggattccagaggatggcatcctttagtatttgctttcacagaagagcaatgcagggggatggagggtgctctggctgatgaaggctagggagggagtggccctgaggccgctggcctctgaactctaactgctttgctctcctgtttcaaaaaaggaacgaaagaaaaaaaagaaaggaagaaaaaaaagaaggtatatcacctctggaagaaaacataccaaaaacaaaacaaaacacaaacccccaaacaaaacaaaaaaccaccaactcaaatatactttcacattttttggagaacatggatttccttcctgtttatttccttggtgacttggtcatacaagcaaacatggcaaaaccctctcagaacccaaaagaacagcacacggatgaaccaaatgtgaggaaagcagctgtgatattttgggtggagagaaacacaagggcaatttggcacaacgctgctagatactgtgggtttacaatcaaccttttcattcccaagctgtacacaaaactctctgtttcttgttacacgcctgcctgctccatgctgaaggagacttcggggtgcttgtagctgagcagaatgtctgtaatacacgtagatggatagcaagaggagtttaaatgctggctgccatcactcaggtctgggtgctcatgacctcccaggcttgccccacattcctcattttccccatcctgaaactgctggctgcccatgagcgaagactgactgagaactgcatccgacatccgggcagagctaagtgctttcccagccacgagactcattcctggcaagttatccagctgtacataagcatcgtcgctgttctggatcgtgtggtgtctctggaaggcccggggcctgtggtgctcatggacggaggggcgtgctgggtacccgagcccattgtgatccggcagctccactgcttgtcctggagaacttctatccatgcagttccctatgacaggctctctgctgggcaccttatttttactgaatgcagcagttggctgatgaccatagggatgtatccccaattcttgggcatgactcacagttcctagcaaagattcatgggtccccaggtccaccggtactcaagagcagagggctgtcatggcaacctttggtcaatgtacttctgaactcttactgtcttggaagccatccttggccccctcacacgagcagtcctcctccatgctctctgaatgcatcagtgccggctggtgagcatacccgtggggcggggtgggtgaggaagcctgtgagacacattcttgtgccctgatttgtagcagatgctgggggctggtgtgatggtgataagagtcagcattttgataagataaagcctggcgctctgtcatgctctgtcccccaaggctgggagccagactccccgcatccccttggttcatgtgcctgaacagttcct

SEQ ID NO: 4442 - DNA, 790 bp, Homo sapiens
  misc_feature (1)...(790): n = A,T,C or G
tcgttgtgntaaggccacgttggggccataagagttggaacaagcgcagataagtcaacagctttttagggctttcttggtaagcccccttctggtgagtagttggtgaccccaccaagtggaggggagactggggaccatggaaacatgggacagctcccacgaagggctccttgcactgcagaattccactcaagggatcttgggtccaggagccgagctgccagtatcagtggagaaggacaaggtgcatggggatcccgccagcaacatcaggatggccatgccgggcacccgctttcctctgtgcaaattcaggatgaaagactaggaggggactcgggacctcttgctctcctttcccagaaaaaaaaagggtggaagagtcagtgtattcaaggtctctctcttgttttgaagatcagaaggagataacccagaccctctctcagccccagccagcagagaagactttggtttctaacaatgaagagaaataaagataacacaaataatagctactgcgtatgcactgcttcaactggggaaaggagaccactgcatctgtcactggcacaagtaagagctgttcacaattacaatgcctaaaggaaatactttgaacaaaaggtgcaagtcacaattcaaatagaacagaatctggttaaacatttctcatttaaacaaaaattccttttctctttatttattaataatgataataacaataatatcaacatttaccaaaaacaatttctacatgatcaagaattaaaatatatgggctgag

SEQ ID NO: 4443 - DNA, 514 bp, Homo sapiens
agactgcatagggtcggcgtgggagacagcagggcctgctgcagtgccgacgtggtatagtgtggcggctgctgatgtgcactgtgagcctctgcactgtcagcactcagctgcttggacaagggacggtgcccatagctgagggtggccatcaggttggtacggtgctgcatctgcatctgaccagcactggggctgatggagatgccgcgcccactggagcctgcagctgtgcctggcatgttgctgagcatgtcaacaggctcttggacttggatggtgacctgctgtgactgagcaggctgctgcatacccaagcaggttagtgccacgttgggaggagaggaacagttctcaggttgctgctgaaagattgcactgcgggaaggtaagccttgaaactgggaagaagatgcagccccgtgaggctggatcatggcactgctcatggggggaggactattactgggctgcctgaagagatggttgttggggtggttggggggtgggcttg

SEQ ID NO: 4444 - DNA, 452 bp, Homo sapiens
  misc_feature (1)...(452): n = A,T,C or G
ncctgggggttgactccaggaaagccaggtaggagcttctgcagatcttccgtaacttccgtgcgtgggtcagccacacccactgtgtgcctcctcattgacaaatagcgcaccaaatgcttcaggggaaggctcttcaccctcatcactgtccaaattcagtgtcccatccggctccacaatttggttctctgggttgatcagctgcacctggggaacgctgatgttcatancagtacctgcctgtccgcctgcagtgtctgttctttgtccagtcccatgtcctccatggccaagaggacatcctcattcagggggtccacctgtctttcttcctttagttgttggcattcagctattaacctgtcaaagttgggatctaacaccaacatatggcggatcaaatgctcacattctgtggacataaaaaatgggatgcggaactttccacg

SEQ ID NO: 4445 - DNA, 428 bp, Homo sapiens
taccctggccctctccgcctggatattgaactggtgcttgaaaggcccagggctcggggcatgctaggaagtgctccgagacgcagggttttatgtctcttatgtcgatcacacagcaggctgtagattgcactatagtgatcataggcatctgatcttaatgactgcagtgtctgttctttgtccagtcccatgtcctccatggccaagaggacatcctcattcagggggtccacctgtctttcttcctttagttgttggcattcagctattaacctgtcaaagttgggatcggcgtcccctagcttcatccacttgtgcttgcagatctgctccatggagaggcgcttattgggatctaacaccaacatatggcggatcaaatgctcacattctgtggacataaaaaatgggatgcggaactttcc

SEQ ID NO: 4446 - DNA, 462 bp, Homo sapiens
  misc_feature (1)...(462): n = A,T,C or G
ggctcctctganggcccaaaacctanaatactgtttcctaacagaaccctttgcctccctggaggccatccaggttcngcaagctggagttaaaaaaggttgtaagtgggcccattttatactcccatcactaaattcccgggataactgaagtgggtcctaactttcatgaaccccattcatagctgtgtgctagcgactcccttacctgtggacataaaaaatgggatgcggaactttccactcagcaccgggcccgcagattctgcagtgtgcttccatcaaatggcagggcaccgcacacaagcacgtagaggacaactccaaggctctgcatcccaaacagagaggatgtacaattaatcacatcaggggaaacaaaaaagactactgtagtgtgtgtatgcagatgatggtgagtcatgcatacgattatggaacaaacttttctgtgccgaaatn

SEQ ID NO: 4447 - DNA, 297 bp, Homo sapiens
ctgatgaaaggctagggagggaagtggcccccttgaggctggcctctgaactcctaactgctttgctctctctctgtttcttgttacacgcctgcctgctccatgctgaaggagacttcggggtgcttgtagctgagcagaatgtcctcattttccccatcctgaaactgctggctgcccatgagcgaagactgactgagaactgcatccgacatccgggcagagctaagtgctttcccagccacgagactcattcctggcaagttatccagctgtacataagcatcgtcgctgttc

SEQ ID NO: 4448 - DNA, 823 bp, Homo sapiens
  misc_feature (1)...(823): n = A,T,C or G
gcggccgccaattttttttttttttttttttttaattttgagacagggtcttgctctgttgcccaggctggcacgcagtggtactatcatagctcactgcagcctcaaacagaagtctgaggctgggcttaagcgatcctcctgcctcagcctctgaaagcactgggaccacaggcatgagccactgttcccagccagcaaaactcttaagtacatgtattagaaattctgtagcagaaactaagtattaccttatgtttaaatgtaagtaaaatgccccatgctgtggcctgacaatagtcattattctacatcattcccctcctcctcccttgctaatagaagccagcttttgcagaattatcaggcagctaactacttagaggcagggccctccccaatcccaggagagtgactcctaattggttcaagccaatcataatggtctcattccccttgccagatggtttaagaaaggcaagtgaccccaatcctaatcaataggacctgagggaaaaactggagggtttccatgaaattgttgtcttgctaacaaaaagagatgtacaggaggaaatattccatttcttcataagacactgttgagtctgcattcaatacagccagagtacaatcatgagagaagattctgagaatggcagagtataaagatgcaaagtgtcggggtccttgattagatcagtgagccactaaattaaccaatcccgaacctgtcttccttctctcccnncntctggacttcttgttctgggagatcttttcttcactggagtgttctgttactgacganctaaggcatcag

SEQ ID NO: 4449 - DNA, 340 bp, Homo sapiens
tttttaatataagtagagagtttatttgagtcaagtttgaggattgcaacctgcgagcatagattcaagttgccctaaatacacactctgattagctgaagttacaagtggatttttaaaggcaaaagcagaggatggggtatgggctgatataaagttgtttgtcaggaattctcattggtttacataaataacattgatttgattggctatacattgttaagctataaagcgtgggttacagtgtctgggtgaggcactattaggttgatctatagctacctgtgggtgatagcaagcagcttcaagagacgaacacattgctcaaagcaggggagta

SEQ ID NO: 4450 - DNA, 669 bp, Homo sapiens
tttttttttttttttaaggaaggatttggctttattcggccaggagctttggcagactcgcatctcaacagctgggagctttggcagactcatgtctcaagaaccgagctccctgaagacagagttcctggcccttttaagggcttacaactctaagggggtccacatgaaagggtcatgatagattgagagcacatgtggttagagtgggggttgatcttttaacctcaggcctgggcatcagtggcaccggctggtcttgccaatgacttcattcctgttgcttttcaacttttacttcctcctcctcttcagagacaggagacagtaagagaaatggcctcacttctcattcccccctttgagaatctcactcactagtgggagttctcactgtcatcttcactacccaggtctttcagtccagttccatcaattcctaaagttacatactctgctttccaacagggataaactagttccaatgggttatagcacacatcaagctggtcacttcttgggctgcatatcttgtactgagtagcattatacacacaagtcccttataaacagaaagtctgttttaactttttgccctacctcagtctgaggaaggtcagttgaagtccttactgtacaagtccaagagtttacgaaaatgagtcccat

SEQ ID NO: 4451 - DNA, 438 bp, Homo sapiens
  misc_feature (1)...(438): n = A,T,C or G
ggattggttttttccaaacttttaacttccctccctggttcctttcnagaagacaggaagacaagtaaagagaaaagggcttcccctccctcaattctccccctttgaagaacctcaactcactaagtgggagttcctnacttccaacctacattacctaggtcttccctgcnagtcccaattccattgactcctagagttacatactctcttgttttccaatggggattaagtagttctactgggttgtagcacacttgagtctggtcacttcctgagctgcataccttgtactgggtggcattatacacacaagtcccttttaaacagaaagactgttttaactttttgccctacctcagtctgaggaaggtcagttgaagtccttactgtacaagtccaaaatttaagaaaaatgagttccacgatgagcttccc

SEQ ID NO: 4452 - DNA, 2580 bp, Homo sapiens
tttttttttgatctcaaaagtattttatttacacacaggaggggaaggaaggggcttttagctttccctaaacatctgcaacaataactcaatcttagaaataaagtaactgatttatagttattacagggaatacaaacattataattccgctcttccatttaaaagattcctttcattatgttcctactgaaacagaatgttactatttaaagagttttttttttttttttttttttttattgaacagttttattctgttttagaataaaaactttgctttaatattgtaaggggtactgcaggtatgccatgctgccagttattgctggggcacaaaacgccccagtcagtgattcggagggctgggaaaacgcataaactcataatttcagagcaagtagaactagtatttacagttttctttcttgaaattggcccgggacatctccaacagtctacacatgtattgccatggtacttgctctgatgctctgaatgcctcggaactgtgttcaatatcatgatttgtgggtcctctaaaaggttttgttgttaacatgcaagcaaacagcactgaacaatattgtctaaactatggctgccaagtactggatcttcataatgaaaccaaattacaaaacactgccttgtagagctatacaaaagatataaaatgaaaataaaaaatgtcaaccagccttaaatattccaattctcctacagtgcagtttctatatctttatcactactgaatgttttaaggagaaagttaagaaaacaatcaaaatattagataaaaatatttaaatctttggatccttttattccatggccttcataaaaacacaaaagtggccagatttttcccactagagcttaaaatatcaaaaagattcactagtaatttataattagcaatgaactctatactgagtcatctgtgggtcatcataggcccaaggaccagtgttgccgtgtgttacaggctaccaaaataatttctagcactctgaatcctcttgaaatatgatggaatgagtcaaggtatcatgactaaattccaggcataataggaaaaacaggttcattgatgcctagttttaaagtcctacaaaaggggggaagattacttatttgaaaatacagctaagtacattctcatctgtgattatttacatttgtatactgaaaatatcgattatctggacagatcctgtgatatgccatttgctacaaaatgaagttcttacaatgagcatgaataattaatcctttttagataatgaaataatgtatcaaatcttcatttatgttccaaacattaaaaaacaaaatcaaaaatgttaagcctggaaaactaagaaaaaaagacccacccataaggctgctgctcagcacatcaacttctgcaaggacacagtatgtttgctgactttaaaatgtttattctttaaaaaattagttgctttttatacagctatacaaagttcttaatgtttctttggcaatggaatataatggaattttacaactatataaaaaagttacctttgcctaagaaacagtatttactgtgtgtacatagttgactgacaaaattctctaccatccagcaccctaattaattgacgaaataagctacctcatattacaggattccccaaaagaaaggaggaaaaagacacacacatacacacacacacacacacacacacacacacacacacacacaaccttctgtggctcaaaacacagtatcacggccctatctgcaggcaacttgcaattgccaaatacaatttagtgataaaaaaaaaaaacctttcagtgatgaaaaaatacttgttaagtcccactgaagtactgctttagtttaactatacataagaaattacttaaccttctgctattcccaaatatatttaatgctcatgttttaagatgagccttccacccccaaaagtaactgcattttatctttgaaattaagcggaaaaacaaacaaaaaacaaaaacccagtgctggtgacaaatgtacagcgaattcacttcttcattctttgcaaagactgaaatcaatgttcaggaccatgaagagctagaaattcacctattttcagagacttgtttgtagactatgcagcaactttgttgtctttctttcagaaagcagtacgatcaatccagaccttttagggtccaaaagctgtggttttcctatattcaaaatccgcaaactcccggcccccacgacctcctctgaatccaccgcgaaatcctcgaggggcagtgaaggtaccacctctgccaccaccacgccctctgccaccacggaaaccaagacctcctctgcctctgtatcccccacggccacggtttggacgaagtgggattccaaatgtttcagcatttaatcttctttcttcagcccaggttggtctccgttctctattgtcatcacaagaaatattatcaaagaaggatttagttttgtcataatagcaattaggtccaagtggatcttcttcatcggcatttccttcactgttttgggtatcaactcctgagtctccttta

SEQ ID NO: 4453 - DNA, 570 bp, Homo sapiens
tttttattgaacagttttattctgttttagaataaaaactttgctttaatattgtaaggggtactgcaggtatgccatgctgccagttattgctggggcacaaaacgccccagtcagtgattcggagggctgggaaaacgcataaactcataatttcagagcaagtagaactagtatttacagttttctttcttgaaattggcccctgccaccccgatgacccccacgccctctccttggagctgaaggagcacctggagctacttgtctcttgttatcatttctgagttgctcattttctggccttgaaactttgtgtacttcagctcgcctgtgctcctgattctctcctgccttttggctggcagatggcaaaggcctggttgatacaggactccttctcccaacagctgctggagcaggtaagtgggctgaggcggtctgcactgcttgttccatggttgggctttttctcaaagggtctaactgagggcttgagcgaccttgagataactgtgtttttagagatcttgtatcctgtgtaaaggcagaaccaaccgcactactttg

SEQ ID NO: 4454 - DNA, 501 bp, Homo sapiens
  misc_feature (1)...(501): n = A,T,C or G
cccagtgctggtgagaaatgtacagcgaattcacttcttcattctttgcaaagagtgaaatcaattgttcggggcgcttgggaagagctaagaaaattcaccctattttgcaagagagcttgttttgtagactatgcagcaactttgttgtgctttcctatattcaaaatccgcaaactcccggcccccacgacctcctctgaatccaccgcgaaatcctcgaggggcagtgaaggtaccacctctgccaccaccacgccctctgccaccacggaaaccaagacctcctctgcctctgtatcccccacggccacgatttggncgaagtgggattccaaatgtttcagcatttaatcttctttcttcagcccaggttggtctccgttctctattntcatcacaagaaatattatcaaagaaggatttagttttgtcataatagcaattaggtccaagtggatcttcttcatcggnatttccttcactgtatngagtaangan

SEQ ID NO: 4455 - DNA, 438 bp, Homo sapiens
  misc_feature (1)...(438): n = A,T,C or G
tcttcctcttcttttcttcttcttcttcctcttccttgttgaattgtgcatttgcactttcaaagtcaaagtctttctcaaatttcattggcccatctcgccgaataccaaatcttcccctgccaccccgatgacccccacgccctctccttggagctgaaggagcacctggagctacttgtctcttgttatcatttctgagttgctcattttctggccttgaaactttgtgtacttcagctcgcctgtgctcctgattctctcctgccttttggctggcagatggcaaaggcctggttgatacaggactccttctcccaacagctgctggagcaggtaagtgggctgaggcggtctgcactgcttgttccatggttgngctttttctcaaagggtctaactgagggcttgagcgaccttgagataactgtgttttta

SEQ ID NO: 4456 - DNA, 511 bp, Homo sapiens
ccaggttggatgcaattattttgatccagtctttacttaattttaaaaattacaaaacataaaaacaaacaaaattttccctaagtggttcaatgcagaacacttgggaagttaagcatatatatataatattttacaacgcaattacatattgacaaattcaatgaaaaagtagaccatctaaatattttaagagattaaacttcacattctctgcaactagaaaaacaataagctactgcatatcagtacatgacattcaaatatattttaaaatgtacttccccctcttaaaatggcagtgagtatacattagtgcaaccacaaagcacttgtaaacttttttctgttcaacatcatccatgtccattagaacaaattctgtttggctggctccaaggcctttcttgggcctgagcttttcatgtttttctgtgttaacagttacagcctttatccataaccgcagccatccatccagaaatgcccaccgtctgaggttgggagagcc

SEQ ID NO: 4457 - DNA, 496 bp, Homo sapiens
ttttcacggtccaggttggatgcaattattttgatccagtctttacttaattttaaaaattacaaaacataaaaacaaacaaaattttccctaagtggttcaatgcagaacacttgggaagttaagcatatatatatatatatatatatatatatatatatatatatatatataatattttacaacgcaattacatattgacaaattcaatgaaaaagtagaccatctaaatattttaagagattaaacttcacattctctgcaactagaaaaacaataagctactgcatatcagtacatgacattcaaatatattttaaaatgtacttccccctcttaaaatggcagtgagtatacattagtgcaaccacaaagcacttgtaaacttttttctgttcaacatcatccatgtccattagaacaaattctgtttggctggctccaaggcctttcttgggcctgagcttttcatgtttttctgtgttaacagttacag

SEQ ID NO: 4458 - DNA, 5750 bp, Homo sapiens
  misc_feature (1)...(5750): n = A,T,C or G
gatcgagacctgcttcttgacctactatgaaaaatgaaaagaaatcagcctagataagactctacaacaaacccattaaatacaacttttgactttaaaaaattagagacctactgtgccttttgctgccttcaattaattttatttttctcccatttatttcctttccagaaagtttttcaatagcattctttaagtcaccataagaggcaaactcaaccaccctaaaatggaaaacagccacttttaaagtatatacatcctgtagtctcacacattgcacacagcagtctaggtaagtcggttctatgttcactttggctattgctactattgagtcttatttctggataacacagcattaaaagagcaaagtttggggcactgttatactttgagccaattcattgttgagggggttccctatgcaccgngggatgcttagcaggatgcctagcccctactgactacatgccaacaggatcctctctcaaccagttgtgacaaccaaacttgtctccagacactgccaaaggtgtgggggggagggagggaagcagcaaaattgtctctggagaatctctgcattctaacatattcaaattttaagtcctcaaaactaagttcacagtaaaattttccggatatttttaaagactttcacagcttccagtacatacccttcatttaatttaggtcgggtgcatccgcaaacgttacttccccagcttgtctcatgaaatctttgagatccttaacacaagataattgtgttaagcaaagaagaggaaaggggacacacaaacaatcacatgatattaaaaaaacaagactactgaaagagaagatgttagataaagtacaaacatggcatttaccacacttgttttctttcaggaattcaaaaattatcttttgtcaagggcacgggattaagcaaattgtatattggttttacagcaaaatgctaaaaggaaattcaaattttaacattaaaggtaggttttagtcttatgctcgagctcagtacaaaagaaaaaaaaacaaacaaaaaaacaacaaaaaaggaaacagtcacatatttttaaagtaaagactaaagtagagaagttttatttaaaaaaacagaacatttacaagacaccagttattttgtgccccatatgtcattaaaaaagtttactttacctttattattatttccctaggctagtcaagcagcaaaccattaatcggtcggagaaaccttcatgacatatgcccgactggctcttcgccacccacttgaaggacactacccaatcgatggaagcctttaatcgcacagccctccctattagcggactattggcggatgcagacatgttctactcgagcagttaccaaggaccactttactgcgatcaggattccaacgaccacctaatttcgtatctttcaactcttttcgaccggacctcttattcggaagcgttacaggaagacaggtctcaacttagggatcagatcacgttatcaacgctctgggatcgctgcaacctggcacttcaaggaagtgcaccgataacgtctagaccggcaaacacagatctagaggtggccaactgatcactgtaggagctgactggcaaagtcaaccaggcccaaccaagagtgaccaagacaacgattaggataacccacaggcactcctcgtcataaggccaacgacacagacaggctggcaaataaagggtttaatatttggttaaaaattgattttgaaaaacaagaaaaatatcctccaaacatttacatttgatcactaatattaaagttcaaaatatcccccaaattacatttaattaaatgtttaaaattacaattccattaaatccattaatttaaaactacttttaataaaacaatacaacattagctacccattaacttttttaaaaagccacagcaaaataactcaaacctgtatttcaacaaacctgccagctgactcttgaggataaattctccaactataagacgattttctgttcttacaggtggagcatttctgaggaagaaaattcgtattcacaatggaagaaatgcaatgacagcacttgtgttcaactgtggccaagttcaagccatcagatatcacaagccattctaatgacttccgtcaatagatttgtgttctatgactcatatagattcatcaagaacaactggctaacgtgggaatagaagaacagattatacggcaggacccaaaatcatcactgctaatgactcctgaatcttaaatgctacccctacaataattgttcaatgcagccatccacccttcacataccgtctatcatttcgaggtctgcgactactaaaacggtcagagtatcgtcctctacctcttccacctcgtgaccgagccctagcatgttcaatagtaaccctacaaaaagggaagaaaaatctccgttacacacttaagctacataaatctacttagaaaaatatgccagcagacccagtctgctctatgtcccagggttatctagttacacaggaatctcacctttcactacagagttcttttccatcaagctcatacacagcatcatctgcatcccttggatcctccaaattcctaaaatgtaagcataaactcttaaccttggctttagcaagagtattctaccacccattaagagcactgaaatcaggagacagaatgggaagagtatcttaacgacactgccatacagtcaaacctaatcaaggagccactgggagtggggttccagtgagccggcaagttaaagttgttttcagcctcaataaaattcagacataaggctgggtaacattttctgaaggcaaatattccacccggactcaagatcgaaaacaactgcttatcaaaactctacctacttagcaggctaattcacccagttctaaatacttaccacaaaaccaaagcctcttttcagatcaatatctcttatccgtccatatcccttgaagaatctttccacgtccttctccctggccgctggatttagtctcccgatgaatacccgacagccactcatgatgtccggctagtacttcctattagaaagtaattcaatcgagataatagcaatgacttgtcacagagaaacgccttgattaaacaatcaaaaacatcaacggcataaaatgtttacacagtgatgttatgaacgagattgccaacagagcctctaatgaggccaggttacctgcagacaaaatgaaaacccagctccctcccaacacggtccgctactgggcccagaccgcagcaaccgcaacgcccactgccacctttccaactgcgcagccgcacactctccgggctctccggccccctcccatctgccgcagttaggaaaggccgagaagtgcgggcggagccgcccgcgccctccgcaaagccagcccaatggcggcctcgcgggcgcgtcacagcgggtggaagccagaatctcgcgacgcctcgaccgcgcctgcgccaacagcagcgggcgggcgctctgcggccacaaaatggcggcggtggaatcaaaggcagcagagctgcgcgtgccaaattccctcttcccttctcctcccagcaacccccttctcgggggtcactgcggccgccctacaaaaggcccagccgcatcgccagcaaagtcagggagatcccggcccactattctacgtgtccaggagatgaagacattaagactggcagggacgggcgcacaaccgctgtgtaaaaacgacccgaacagtgaccgccctttcacctcagtacccctcaaacagtatgccaaaagggagacgtgccccagcgcccacctcgaatcaactgcgctcattagacgccatcctccgcaaagagagcagccccggccgctcacgatctgagcggccatgaagaagcctcgatccgagaaggcttgccctcaaagtgagccactcacctaccggacggggtctttggcggctgagacccagacaggtccgtagtctgcgacggagtcgtcgacctccacgcagaccaggacttaactcgtctacgccactccacaactgacgcacttagcagctctggcgctccacaaaatggagggcgcgtcctacgtcacttccggggacgcccctgggccttgggtccaccccgttggacctagggaagacggaagtttggggagggccggaaatttaggaggatgtgggtctctctgacactgcgagtgaccgaaccctgctcccgcggtgggtggggtcgggggcgagaactcgtttgggttcggccggttggtgccggggtttggagggacatctgttgacgtcgtccgcccctgttaagtcctgggggtccggtccatcatcatctctcccagaagagtctcctgagaaaagtggaaaccctccttgtatctaaagtttctcttgagacacccagaagattactatttaggagaaacttagtttggggagaaatacctggcctcccctgagctcttgtgtttgcaatttaattgtgccctcaaaggagggagctcctagatgttcgagttcttttcacacccatgacacagctgtgtggttttgttgtggcgagaagacttaaggcactgaagtatttttcaaatgaaaggattttcactgatgaaatgttggaaaatgggacttgcagctagaaggctgtcttgaattgaggctggaattacagatttcttgcatcgtccgccactctgggaggagttggctggaaggaggctctcaagctgctttttgctgttttcttcgagacagtcttgctctgtcgcccaggctggagtgcagtggcgcgatctgggctccggctcccgggttcacgccatccttctgtctcagcctcccgagtagctgcgactacaggcgcccgccaccacaccggctaatctttccgccttcctaggagagacggggtttcaccgccttagccgggatggtctcgatcctcctgacctcgggatcggcccgcctcgccctccccaaagtgctgggctaacagcatgagccaccgcgcccgggctcaaggttgcttttaagtcccaaatggtatttcggttaatcctctcccttcagatttcttggtaatgtaacacatgaaagtttacaattctttagaaacagacaatcccgtgctttcaaagtgggtgtaaaacacagccctccatattaactcccgcgttgtcccgataaggttggtagacctagaaacttaggcataaagagattgcttaacctcgccttaatgcttttatgtagcacccagttcaccccaattttcagcagttcccgggatgtggactttcattccttccaccaaaagtaaccagaagaaaagtagttccgggaaggagagcaactgacccttaactcgacctcaggggcctttaggcactcagaactgaaacttggatagtttgtaagggataagcttgtccattcatagttatatgtacaaataaaaagagcctcagtgaagttagttacctataatgtgggagttaaggatgggtttataacacaatatgtatttaatgtatttgttcaatgaaaagaaaaaaatgttacctagttgttggcctgatgaacattggcattttataatgcacaaattgtcccaaaccagttggtatttaattacatttgtttggtttctgcataataaacaagtcttccgattaaaaaaaaaaaaa

SEQ ID NO: 4459 - DNA, 1679 bp, Homo sapiens
  misc_feature (1)...(1679): n = A,T,C or G
ccaagtacanaaaaaattaaagtgctttagtaaaaaaaacccgtcaatatacacaaactatttttttttttttttttttttttttttttttttttttttgcttatcaaaagacatttaatacaattagttttcaacaaccccttggtggtccacatctacaaagatatccagcccaacccaaccccccttccaaatcccacccccacagaaaagcacatacttaccagaatttttagcaagtatggtttgggaatttttgtggtttttgttttttaaaaaaaggcccccagggcaagttatttacagtttaattgccactgtcaactgatctggaccttgatcgggaccgggacctctggcgatccacagatgctggagacttagatctacttgaagaaccacgtttctggctcttctcaggcacgggagacctactaacagaacgggacttgctccggctccggctcctgctcctgcttcttgaccggctgtaagatttgcgactacgggaacgggatcggctacgagacctagaggaacttctggtccgggatcgagacctgcttcttgacctactgtgccttttgctgccttcaattaattttatttttctcccatttatttcctttccagaaagtttttcaatagcattctttaagtcaccataagaggcaaactcaaccaccccttcatttaatttaggtcggtgtgcatccgcaaacgttactttccccagcttgtctcatgaaatctttgagatccttaacacaagataattgtgttaagcaaagaagaggaaaggggacacacaaacaatcacatgatataaaaaaaacaagactactgaaagagaagatgttagataaagtacaaacatggcatttaccacacttgtattctatcagaattcaaaaattatctatgtcagggcacggaataagcaaatagcatattgcttttaagcaaaatgctaaaagaaattcagattttaacattaaggtagtattagtctatgctgagctcagtacaaaagaaaaaaaaacaaacaaaaaaacaacaaaaaaggaaacagtacatatttttaaagtaaagactaaagtagagaagttttatttaaaaaaacagaacatttacaagacaccagttattttgtgccccatatgtcattaaaaaagtttactttacctttattattatttccctaggctagtcaagcagcaaaccattaatcggtcggagaaaccttcatgacatatgcccgactggctcttcgccacccacttgaaggacactacccaatcgatggaagcctttaatcgcacagccctccctattagcggactattggcggatgcagacatgttctactcgagcagttaccaaggaccactttactgcgatcaggattccaacgaccacctaatttcgtatctttcaactcttttcgaccggacctcttattcggaagcgttacaggaagacaggtctcaacttagggatcagatcacgttatcaacgctctgggatcgctgcaacctggcacttcaaggaagtgcaccgataacgtctagaccggcaaacacagatctagaggtggccaactgatcactgtaggagctgactggcaaagtcaaccaggcccaaccaagagtgaccaagacaacgattaggataaccc

SEQ ID NO: 4460 - DNA, 1102 bp, Homo sapiens
  misc_feature (1)...(1102): n = A,T,C or G
ttttttttttttttttttttttttttttttttttttagttttataatattttattatcaataacaaacagctgctctaatgtgtctgtccagcagctgttaaagagtggaggacacccttgaccctaacaaggaaaacaaattaagcctttatgtacaagcaaatttagagctcttttaagtgtccaaagctattaattagtttaattaaggcattaaactaattctgaattaacatttttataaccaagaactaaaatgttcaaatttttttctagtacaaaaaaattaaatttgctttagttataaaagagctctgtcaatatacacaaactatatacttcagacattcacaaaaatgtgagcagaaggcttatcaaaagacatttaatacaattagttttcaacaaccccttggtggtccacatctacaaagatatccagcccaacccaaccccccttccaaatcccacccccacagaaaagcacatacttaccagaatttttagcaagtatggtttggggatttttgtgggtttttgttttttaaaaaaaggcccccagggggaaggtttatttacagtttaattgccactgtcaactgatctgggaccttgatcgggaccgggacctctggcgatccacagatgctggagacttagatctacttgaagaaccacgtttctggctcttctcaggcacgggagacctactaacagaacgggacttgctccggctcctgctcctgcttcttgaccggctgtaagatttgcgactacgggaacgggatcggctacgagacctagaggaacttctggtccgggatcgagacctgcttcttgacctactgagccttttgctgccttcaattaattttatttttctcccatctatttcctttccagaaagtttttcaatagcattctttaagtcaccataagaagcaaactcaaccaccccttcatttatttatgtcggtgtgcatccgcanacgttacttacccagcttgtctcaatgaaatcttgagatcctgccagctgactcttgnagggataatctcaactataagacgatctttctgtcttacaggtggagcatttcg

SEQ ID NO: 4461 - DNA, 743 bp, Homo sapiens
ggcaaataaagggtttaatatttggttaaaaattgattttaaaaaacaagaaaaatatcctcaaaacatttacatttgatcactaatattaaagttcaaaatatcccccaaattacatttaattaaatgtttaaaattacaattccattaaatccattaatttaaaactacttttaataaaacaatacaacattagctacccattaacttttttaaaaagccacatcaaaataactcaaaactgtatttcaacaaacctgccagctgactcttgaggataaattctcaactataagacgattttctgttcttacaggtggagcatttcgtctatcatttcgaggtctgcgactactaaaacggtcagagtatcgtcctctacctcttccacctcgtgaccgagccctagcatgttcaatagtaaccctttcactacagagttcttttccatcaagctcatacacagcatcatctgcatcccttggatcctcaaattccacaaaaccaaagcctcttttcagatcaatatctcttatccgtccatatcccttgaagaatctttccacgtccttctccctggccgctggatttagtctcccgatgaatacccgacagccactcatgatgtccggctagtacttccggacggggtctttggcggctgagacccagacaggtccgtagtctgcaaggagtcgtcgacctccacgcagaccaggacctaaacctcgtgccgaattcgg

SEQ ID NO: 4462 - DNA, 687 bp, Homo sapiens
  misc_feature (1)...(687): n = A,T,C or G
tttttttttatcaaaagacatttaatacaattagttttcaagcaccaaggggttgttgaaaactaattgtattaaatgtcttttgataagccttctgctcacatttttgtgaatgtctgaagtatatagtttgtgtatattgacagagctcttttataactaaagcaaatttaattttttaatgacatttacaagacaccagttattttgtgccccatatgtcattaaaaaagtttactttacctttattattatttcccttggctagtcaagccagcaaaccattaatcggtcggagaaaccttcatgacatatgcccgactggctcttcgccacccacttgaaggacactacccaatcgatgggaagcctttaatcgcacagccctccctattaggcgggactattgggcgggatgcaggacatgttctacttcgaggcagttaccaagggtccactttacttgcggattcagggattccaacggaccaccttattttcggtatcttttcaactctttttccgaccgggacctctttatttcgggaaggcgtttacaggggaggncaggggttttcaatttngggggnttcagnttcacggttttttcaacgttttgggggnttcgttgncaacngggggnattttcaaggggtgttgnaacccgnttaacgttttggnaccggg

SEQ ID NO: 4463 - DNA, 564 bp, Homo sapiens
  misc_feature (1)...(564): n = A,T,C or G
tgggaagacttaagacctacttgaaanaaaccacgtttctggctccttcctcaaggcaacgggagacctaactaaaccagaacgggacttgctcccggctcccgctccctgctcctgccttcttgaccggctgtaagatttgcgactacgggaacgggatcggctacgagacctagaggaacttctggtccgggatcgagacctgcttcttgacctactgtgccttttgctgccttcaattaattttatttttctcccatttatttcctttccagaaagtttttcaatagcattctttaagtcaccataagaggcaaactcaaccaccccttcatttaatttaggtcggtgtgcatccgcaaacgttacttccccagcttgtctcatgaaatctttgagatccttaacacaagataattgtgttaagcaaagaagaggaaaggggacacacaaacaatcacatgatataaaaaaaacaagactactgnaagagaagatgttaggtaaagtacaaacatgggatttaccacacttgtattctatccagnattcaaaaattaatna

SEQ ID NO: 4464 - DNA, 444 bp, Homo sapiens
  misc_feature (1)...(444): n = A,T,C or G
tacctccggaggaaggttcccaaagggnttcaccttttaccttgcacatccagggatttccccaaaccgcccaacccccctaatttccgtaatcctttcaaactccttttccgacccggaccctccttattcgggaagccgttacaggaagacagggtcctcaaccttagggatcaggatcaccgttatcaacgctctgggatcgctgcaaccctgggacttcaaggaagtgcaccgataacgtctagaccggcaaacacagatctagaggtggccaactgatcactgtaggagctgactggcaaagtcaaccaggcccaaccaagagtgaccaagacaacgattaggataacccacaggcactcctcgtcataaggccaacgacacagacaggctggcaaataaagggtttaatatttggttaaaaattgattttaaaaaaaa

SEQ ID NO: 4465 - DNA, 496 bp, Homo sapiens
ctcaactataagacgattttctgttcttacaggtggagcatttcgtctatcatttcgaggtctgcgactactaaaacggtcagagtatcgtcctctacctcttccacctcgtgaccgagccctagcatgttcaatagtaaccctttcactacagagttcttttccatcaagctcatacacagcatcatctgcatcccttggatcctcaaattccacaaaaccaaagcctcttttcagatcaatatctcttatccgtccatatcccttgaagaatctttccacgtccttctccctggccgctggatttagtctcccgatgaatacccgacagccactcatgatgtccggctagtacttcctaccggacggggtctttggcggctgagacccagacaggtccgtagtctgcacggagtcgtcgacctccacgcagaccaggacttaactcgtctacgccactccacaactgacgcacttagcagctctggcgctccac

SEQ ID NO: 4466 - DNA, 840 bp, Homo sapiens
  misc_feature (1)...(840): n = A,T,C or G
agttaaattancanaaacantnncaaggngcagantgtaaagggngccctgcctacaggaacaatagcttnggcanaattagngccttagtgccaagcattaatagttattaggcataactaatctgattacattttataccagacttaaatgtcaaattttttcagnacaaaaaattaaattnctttagttataaaagagctctgcaatatacacaaactatattacttcagactttttttttttttttgttgccagaaggcttatcaaaagacatttaatacaattagttttcaacaaccccttggtggtccacatctacaaagatatccagcccaacccaaccccccttccaaatcccacccccacagaaaagcacatacttaccagaatttttagcaagtatggtttgggaatttttgtggtttttgttttttaaaaaaaggcccccagggcaagtttatttacagtttaattgccactgtcaactgatctggaccttgatcgggaccgggacctctggcgatccacagatgctggagacttagatctacttgaagaaccacggtttctgggctcttctcaggcacgggagaccctactaacagaacgggacttgctccggctcccgggctcctgcctccggctcccgtgatcgggttcttgaccggctgtaaaatttcgcactacggggaacggggatcgcttcaaaacctataggaacttctggtgcgggatcgaaaactgcttcttgacctactgggccgttttgctgcccttaattaagtttatatttttgccatttatatcccttcagaaaaggttttcaaagcatttctt

SEQ ID NO: 4467 - DNA, 672 bp, Homo sapiens
  misc_feature (1)...(672): n = A,T,C or G
aancggtggaaaatagaagaacagatnttccggcaaggacccaaattcatcnctggtaanggactcctgaaatcttaaatggctacccctaccaataattgttcaatgcagccatccacccttcacataccgtctatcatttcgaggtctgcgactactaaaacggtcagaagtatcgtcctctacctcttccacctcgtgaccgagccctagcatgttcaatagtaaccctttcactacagagttcttttccatcaagctcatacacagcatcatctgcatcccttggatcctcaaattccacaaaaccaaagcctcttttcagatcaatatctcttatccgtccatatcccttgaagaatctttccacgtccttctccctggccgctggatttagtctcccgatgaatacccgacagccactcatgatgtccggctagtacttcctcgaatcaactgcgctcattagacgccatcctccgcaaagagagcagcccccggccgctcacgatctgagcggccatgaagaagcctcgatccgagaaggcttgccctcaaagtgagccactcacctaccggacggggtctttggcggctgagacccagacaggtccgtagtctgcgacggagtcgtcgacctccacgcagaccaggacttaactcgtctacgcc

SEQ ID NO: 4468 - DNA, 515 bp, Homo sapiens
  misc_feature (1)...(515): n = A,T,C or G
tgcttgtctcatgaaatctttgagatcctgccagctgactcttgaggataaattctcaactataagacgattttctgttcttacaggtggagcatttcgtctatcatttcgaggtctgcgactactaaaacggtcagagtatcgtcctctacctcttccacctcgtgaccgagccctagcatgttcaatagtaaccctttcactacagagttcttttccatcaagctcatacacagcatcatctgcatcccttggatcctcaaattccacaaaaccaaagcctcttttcagatcaatatctcttatccgtccatatcccttgaagaatctttccacgtccttctccctggccgctggatttagtctcccgatgaatacccgacagccactcatgatgtccggctagtacttcctaccggnacggggtctttggcggcgtgagacccagacaggtccgtagtntgcgacggagtcgtcgacctccacgcagaccaggacttaactcgtctacgcca

SEQ ID NO: 4469 - DNA, 487 bp, Homo sapiens
  misc_feature (1)...(487): n = A,T,C or G
gnttttggtttttaaaaaaaaagccccccaggncaagttaattaaaatttaaatgcccactgttcaaactggatctggnaccttgaatcgggaaccgggacctctggcgaacccacagatnctggagacttagatctacttgaagaaccacgtttctggctcttctcaggcacgggagacctactaacagaacgggacttgctccggctccggctcctgctcctgcttcttgaccggctgtaagatttgcgactacgggaacgggatcggctacgagacctagaggaacttctggtccgggatcgagacctgcttcttgacctactgtgccttttgctgccttcaattaattttatttttctcccatttattcctttccagaaagtttttcaatagcattctttaagtcaccataagaggcaaactcaaccaccccttcatttaatttaggtcggntgtnatccgcaaacgttancctgtgccgaat

SEQ ID NO: 4470 - DNA, 683 bp, Homo sapiens
  misc_feature (1)...(683): n = A,T,C or G
ttttttttttagttttataatattttattatcaataacaaacagctgctctaatgtgtctgtccagcagctgttaaagagtggaggacacccttgacccagaatttttagcaagtatggtttgggaatttttgtggtttttgttttttaaaaaaaggcccccaggccaagttatttacagtttaattgccactgtcaactgatctggaccttgatcgggaccgggacctctggcgatccacagatgctggagacttagatctacttgaagaaccacgtttctggctcttctcaggcacgggagacctactaacagaacgggacttgctccggctccggctcctgctcctgcttcttgaccggctgtaagatttgcgactacgggaacgggatcggctacgagacctagaggaacttctggtccgggatcgagacctgcttcttgacccttcatttaatttaggtcggtgtgcatccgcaaacgtnacttccccagcttgtctcatgaaatctntgagatccttaacacaagataattgtgttaagcaaagaagaggaaaggggacacacaaacaatcacatgatataaaaaaaacaagactnctgaaagagaagatgttagataaagtacanacatggcatttaccacacttgtattctatcagaattcaaaaattatctatg

SEQ ID NO: 4471 - DNA, 490 bp, Homo sapiens
  misc_feature (1)...(490): n = A,T,C or G
ggactcttgggggataaattcncaaactataagacgattttcctggtcttacaggtggagcatttcgtctatcatttcgagggtctgcggacctactaaaacggtccagaagtatcgtcctctacctcttcccaacctcgtgaaccgagccctagcatgttcaatagtaaccctttcacctacagagttcttttccatcaagctcatacacagcatcatctgcatcccttggatcctcaaattccacaaaaccaaagcctcttttcagatcaatatctcttatccgtccatatcccttgaagaatctttccacgtccttctccctggccgctggatttagtctcccgatgaatacccgacagccactcatgatgtccggctagtacttctaccggacggggtctttggcggctgagacccagacaggtccgtagtctggaccggggcgtcgacctccacgcagaccaggacttaactcgcgtctacgcca

SEQ ID NO: 4472 - DNA, 524 bp, Homo sapiens
  misc_feature (1)...(524): n = A,T,C or G
ctttgcttatcaaaagacatttaatacaattagttttcaacaaccccttggtggtccacatctacaaagatatccagcccaacccaaccccccttccaaatcccacccccacagaaaagcacatacttaccagaatttttagcaagtatggtttgggaatttttgtggtttttgttttttaaaaaaaaaggcccccagggaaaggttatttacagtttaattgccactgtcaactgatctgggaccttgatcggggaccngggacctctgggcggatccacaggatgctgggaggacttaggatcttactttggagggaaccacggtttctggggctctttctcagggcacgggggaggaccctacttaacaggacggggggactttgcttccgggcttccgggnttcctggcttcctggctttntttgacccggctnttaagggatttgcggactacggggggacggggggatcgggctacggngggactaggagggggacttttngggtcccggggntcgag

SEQ ID NO: 4473 - DNA, 568 bp, Homo sapiens
  misc_feature (1)...(568): n = A,T,C or G
tttttttgcttatcaaaagacatttaatacaattagttttcaacaaccccttggtggtccacatctacaaagatatccagcccaacccaaccccccttccaaatcccacccccacagaaaagcacatacttaccagaatttttagcaagtatggtttgggaatttttgggggtntttggtttttaaaaaaagggccccagggcaaggtatttaccggttaattgccactggcaactggatctggaactttggatcgggaccgggacctctgggcgatccacagatgcttgggaatttttaaatctactttgaagaaccccacggtttctgggctctttctcaggcacccggaagacccctactaacagaacaggggaattggcttcgggttcgggcttctcggtcctggttttttagcccgcttgttaaggaattgtgagctaccgaaccccgggggatcggggttccgaacctaaaaggaaatttttggggcnggggggggaatccagaaccttgctttttggcccctacactggggcccttttgggtcgcgctcccttaaaaaann

SEQ ID NO: 4474 - DNA, 372 bp, Homo sapiens
  misc_feature (1)...(372): n = A,T,C or G
ctcatacacagcatcatctgcatcccttggaacctnaaaattccaaaaaaccaaagcctnttttcagannaatatctntttatccgtccatatcccttgaagaatctttccacgtccttctccctggccgctggatttagtctcccgatgaatacccgacagccacncatgatgtccggctagtacttcctgcagacaaaatgaaaacccagctccctcccaanacggaccgctactgggcccagaccgcagnaaccgcaacgcccactgccacctttccaactgcgcagccgcacactctccgggctctccggccccctcccatctgccgcagttaggaaagttgcgagaagttnggcggagccgcccgcg

SEQ ID NO: 4475 - DNA, 662 bp, Homo sapiens
  misc_feature (1)...(662): n = A,T,C or G
aaaaggctaatcggangaaaaangnttcatggttccaaaacaancanaaggcccccaatagggnnaaaaatnggnccaattngggttgtaaggaggncaggnaaatgttngggaanttttnaggnngtggttgttnacttgaacccttncnnaaatggnggcccccttttagcccaccanggggggtaaantttttacccnccccaaaagggttttnccccagtgccaaaaactgggcccccttggacnaacagntaaatttacaaggggnnttaggggggtcctgngggggccaattnaaagntganctnagnanctancntggccncntgaccnaactgtnnntnttggtggcttnaatcaacttattttcncccatttatncctnnccanaaancgggtgaacancnttnnntnagccacgntaacangnaanntnaannnggcccttacatttnattcaggtnggtgtgcanccgcaancgttactnccccagcttgnctcatgaaatctttgagancctgccagctgactcttgaggataaantctcaactataagacgattttctgttcttacaggtggagcatttcgtctatcattncgagnctgcgactactaaaacggtcagagtagcgtcctctacctctntctctgccgaa

SEQ ID NO: 4476 - DNA, 467 bp, Homo sapiens
tatttacaagtttaaattgccacttgtcaactgatctggaccttgatcgggaccgggacctctggcgatccacagatgctggagacttagatctacttgaagaaccacgtttctggctcttctcaggcacgggagacctactaacagaacgggacttgctccggctccggctcctgctcctgcttcttgaccggctgtaagatttgcgactacgggaacgggatcggctacgagacctagaggaacttctggtccgggatcgagacctgcttcttgacctactatgaaaaatgaaaagaaatcagcctagataagactctacaacaaacccattaaatacaacttttgactttaaaaaattagagatacctgtgccttttgctgccttcaattaattttatttttctcccatttatttcctttccagaaagtttttcaatagcattctttaagtcaccataagaggc

SEQ ID NO: 4477 - DNA, 324 bp, Homo sapiens
gaacaaaacgactatcccggaatttattttacagatgatttttttttttttttttaagacagagtctccctctgtcacccaggctgaagtgcaggggtgcagtctccctccctattagcggactattggcggatgcagacatgttctactcgagcagttaccaaggaccactttactgcgatcaggattccaacgaccacctaatttcgtatctttcaactcttttcgaccggacctcttattcggaagcgttacaggaagacaggtctcaactagggatcagatcacgttatcaacgctctgggatcgctgcaacctggcact

SEQ ID NO: 4478 - DNA, 397 bp, Homo sapiens
  misc_feature (1)...(397): n = A,T,C or G
ccaatgtnaaactggaatctgggacccttggaacgggnaccggggaacctctggncggancccaacagangctggnaaaacttaagatcctacttgaaagaaccacgtttcctggctcttcctcaaggcacgggagaccctactaacagaacgggacttgctcccggctccggctccctgctccctgcttccttgaccggctgtaagatttgcgactacgggaacgggatcggctacgagacctagaggaacttctggtccgggatcgagacctgcttcttgacctgtgccttttgctgccttcaattaattttatttttctcccatttatttcctttccagaaagtttttcaatagcattctttaagtcaccataagaggcaaactaaaccacccc

SEQ ID NO: 4479 - DNA, 351 bp, Homo sapiens
  misc_feature (1)...(351): n = A,T,C or G
cacagatgttggagacttagatctacttgaagaaccacgtttctggctcttctcaggcacgggagacctnctaacagtaacgggacttgttccggntccggctcctgctcctgcttcttgaccggttgtaagattngngactacgggaacgggatcggctacgagacctagaggaacttctggtccgggatcgagacctgcttctngacccttcatttantttaggtcggtgtgtatccgcaaacgttactnccccagcttgtctcatgaaatcttngagatcctnaacacaagataattgtgttangcaaagaagaggaaaggggacacacaaacaatcacatgatataa

SEQ ID NO: 4480 - DNA, 496 bp, Homo sapiens
ttttttttttttgcttatcaaaagacatttaatacaattagttttcaacaaccccttggtggtccacatctacaaagatatccagcccaacccaaccccccttccaaatcccacccccacagaaaagcacatacttaccagaatttttagcaagtatggtttgggaatttttgtggtttttgttttttaaaaaaaaggcccccagggcaagttatttacagtttaattgccactgtcaactgatctggaccttgattgggaccgggacctctgggcgatcacagatgctggggacttagatctaacttgaagaccacgtttcttggctctttcagggacgggaggacctactaaaagaacgggattgtttcggctccggctcctggctctggtttctggacggcttgtaaaatttggactaggggaacgggttggctacaggaactaaaagaacttctgtcccggatagagaaccgcttctctgctcggggcgatt

SEQ ID NO: 4481 - DNA, 305 bp, Homo sapiens
  misc_feature (1)...(305): n = A,T,C or G
cacagatgctggagattagatctacttgaagaaccacgtttctggctcttctcaggcacgggagactactaacagaacgggacttgctccggctccggntcctgctcctgcttcttgaccggctgtaagatttgcgactacgggaacgggatcggctacgagacctagaggaacttctggtccggtatcgagacctgcttcttgacccttcatttaattttaggtcgggtgtgcatccgcanacgtcacttccccagtttgtctcatgaaatctttgagatccttaacacaagatatttgtgtta

SEQ ID NO: 4482 - DNA, 336 bp, Homo sapiens
tccatcaagctcatacacagcatcatctgcatcccttggatcctcaaattccacaaaaccaaagcctcttttcagatcaatatctcttatccgtccatatcccttgaagaatctttccacgtccttctccctggccgctggatttagtctcccgatgaatacccgacagccactcatgatgtccggctagtacttctaccggacggggtctttggcggccgagacccagacaggtcggtacgtcctggacggagtcgtcgacctccacgcagaccaggacttaacccgtctacgccactccacaactgccccactcagcagctccgcgccccccaa

SEQ ID NO: 4483 - DNA, 244 bp, Homo sapiens
ttcagatcaatatctcttatccgtccatatcccttgaagaatctttccacgtccttctccctggccgctggatttagtctcccgatgaatacccgacagcaactcatgatgtccggctagtacttccggacgggtctttggcggctgagacccagacaggtccgtagtctgcgacggagtcgtcgacctccacgcagaccaggacttaactcgtctacgccactccacaactgacgcacttagc

SEQ ID NO: 4484 - DNA, 1223 bp, Homo sapiens
cgtcgactttttttttttttttttttgacaatgcattttttctcatttattcaaattcactgcaggaagtaaacactaaaagattaaaaaacaaaacaaaaaaattcacactgcagtatgtacagtttcatgacatcacatgaagaaattaaatttctaataaaaatggcaaattatattactgagcagatcgcatcaaatttggttgtgtaaacaccagaattcttactatgaatggtaatgtgcctatattccagtattgctaatactgggatactcttggaataatgtttgcaatgggattaaaaaattcatgaaagtagttgtgtgaattctttatgtttaaaagtggttgacgattaaaaaaattctttaagacccttcgaatcaaagcacattctttcacaaagcttaaaccacagacgtcatgtccagaaatggaatactgtcatgttaggatgaacatctgatctgatttgttaagacattttgccaaatgcacagatgcacagggtcccccatgcacttttcatgcagcaggtaatcacaacttaaataaaaggtttattctatacatttgtccagacttgcaactgtatacatacatgcacaacttttaaacctgtctgattatatttacacttatacatggaatatacaggaaccaaagagattaaaaggcttttctgttgcattagaacaatacaaaatatgtatttttcattaaggaaatcactatttacatcacctttaaaaaccgattttaacatcttcatgtaacaagtcaatatatatatatatacatattatatatatatatatatatatatatataaaatatatactctcaccagtttactcttctgtaagatgcagcagagaataaacaggtaatgaatgctaccttactgatgtcaataagctgtagtaccctttcacaaatgactttattagaagaaattgtctagatatctaaaatagtccttgaaaatgtgtatatgtgcatccttgtatctacatatgcataaacaaagtgaatctgtggatgtatgccctttctcactgttctttaaaatcaccctaaattcaaattgggaacattctctagtaaatcagaacagcattcttcgtggtcatgtttatttaagtattacatattctcattcctttgttaacaacaacgaaaacaaccagccaaccaaaaaaacaaaacaaaacccaca

SEQ ID NO: 4485 - DNA, 651 bp, Homo sapiens
  misc_feature (1)...(651): n = A,T,C or G
ttttttttttgaacagcgaaagtgagacttttaatgacggtcttgcaagatcgggtgtctggcatgcaggcacacccagcacagtttcaacaagcaatttacgccctagtgcacaggtccctccctcagttcctcataggctgagtactagccttccacaatcttcctagacatcacctattgattgttcttcaagtacattctttagggtctttctgctgcattttattgcagcatacaatgcattatgactctcaggatttttcaaacatttgacttacggctctagtggctgcacttagctgataagaaagggtacaattatctatgttgcaagctagcttaaactaaatttctctgtggagtggggaaggggtagatgagggggcccccaccgatagatgcctggccactgggtgaaagggaaagaaggaaggtggagggggtggctcagtacattctgcttctttatttctttatttccaggtagcctgcctaaacctataccaagccacttagaattgaaaataaggtaatcacatataggttatttcctacaattccctcccttttccttttacccttttcctcgtgccgaattcntggcctcganggcaattcccanagtgagtcggataaatcgnaacaggc

SEQ ID NO: 4486 - DNA, 484 bp, Homo sapiens
  misc_feature (1)...(484): n = A,T,C or G
ttgtacagcgaaagtgagacttttaatgatgctcttgtaatattgggtgtctggcagcaggcacacccagcacagtttcaacaagcaatttatcccctagtgcacaggtgcctcccccagttccccatgggctgtgtattatggggtcacaatcttcccggacattgcctattggtcgttgggtaggggctttgggtgttttctttagggttgtcctgctgcgttttgttgcagcccacaatgcattgcaatcctagttagctcaggggctcttcaggtatttgacttatgacttaagtagctggggcaggctgataagaacaggcaacacgagctattttgcagctagtaaactttcatctcagactaaacttctttggatcgggtgagggccattaagcggcggggtggcggngaggggacaagaagccggcattgactacgcaagcaggggcctagtttatcctgtttcttctgtagtttg

SEQ ID NO: 4487 - DNA, 397 bp, Homo sapiens
aacagcaaaagtgagacttttaatgatggtcttgcaagatcagtgtctgataggcacacccaacagtttcaacaagcaatttatcccctagtgcacaggttcctcccctggttcctcataggctgataactatggggtcacaatcttcccggatgttgcctattgattgttgggtaggggcttcaggtgttttgttttttgatttttgtgagacagagtcttgttctgtcaccaggctggagtgcagtggtgcaatcacggctcaccgcaacctccgcctcccaggttcaagtggattctcctgcctcagcctcccgagtagctgggaccacaggtgcgtgccaccacgcccagctaacttttctatttttagtagagatggggtttcaccgtgtcg

SEQ ID NO: 4488 - DNA, 2179 bp, Homo sapiens
  misc_feature (1)...(2179): n = A,T,C or G
aatcttttttactcctcactgacttgaagctcaaaactttcctatttagcttctaatcacacactctctctttttttttttttttttttgagaaggggtctcactgtgttgccctggctggtcggtctcaaacctctggcctcaagccatcctcccatctcatccttcccaatagctgggattacaagtatgggccatcatgcctgagtaaattcttaataaatnccggtttctgaatggatggacggaagtatgaatgaatggcgaagtgaatgaaggaatcaacttctggacggaagtatgaatgaatggcgaagtgaatgaaggaatcaacttctttctccttagtgggtgtgtgtgggcacagcaggctgaccctcgcctgtcagcgaacccaccccctcctccccggcacagggagctacagctctgtgtgtctctcttcaggctcctcgagctcctggatcttttggggcagcgccttcttccagaactggagcctgtgggccttcagagcccggcccaccgcaggctgtaggttcagctgcaggtattgctcctcctggtcgaacagcggccagtgtggcagaccctcgccattggggttcccatttctcgcaaagttggcccagtacttcatcatcttcctgcttagctgctcctcttcctcagtgaatttaatgtagttgcccccaaagaaacttctgaaaacaaaaggaagctcatcaccatggtctgccttcatgtgcggtggcctgatgttcttgagccagctgggctgatgctggaactcgtagaagtacacaggggcccgggaacactgaaaatgtgctacttggagtgcagggatcacaaacatggagtccgccatcatctcctggaactgcgcttggagggtctggggatccccattgtccccaatgtactcctccctcagcaggtcaccaaatgtaggaggcaacatcagcagcgttaacattttctgcagagcagcctgggaggcctctctgtccatttccttctgggtatcatagatcctcatgaccttggggatgagccagccgaattcattgttgttgacaccaacaatgctagggacaggctgaaagtcggcagaggccagcagctcctgggggtgcctgggcaggaagaccccatccaccactccggggatcatcttgaaaggcttgttaattgcaagaatctcctctttactcttgccccgcaggcagcccaccagggcctcagagtcaacttggtcacaggcagacaggttggccaccaccgtggagatgacatcagctgagctggcaatgaggccgggcaggagggccacgccactctccatgatggctccgtggaagagtccttgggatatgggggacacaacaagcgaagacacactcgtgccacccgcagactcgccaaaaatggtgacacggtcagggttgcctccaaagtgggcgatattctgctggacccagcgtagtgcagccacttggtccaggtagccccagttgccggttgcgtgcttgtctccagtgctgaagaagcccaggacacccaggcggtactggatgatgaccaccaccacgttctccaaggcagccagcatggaaccatcatacaaggaagccatgccaaaaacaagcgcaccaccgtggatccacaccatcaccggcaggttagagccttcatggctatgggccggcgtgtagatgctgaggtacaggcagtcctcagacatggagtcggaagggaaggtcatgttgaactggctaagaaactctgactccactgcggtgaggtcctgtagacacatggccggatgggtggttccatccctcacaccactccaagattcagggggctcagggggtgcaaatcgcagcggacctagaggtggcttggcaaatggaattcccaggaaggtttggaccccggcattggcgcccttcacatggacaagactccccagcacctgccccgtgtgtgtggtccggatgggactggctgagtcctggccctggccccggacaagaagcagcagaagcccacaggccaccgcgctcagccgcgcacgaagtctgtgcagccgcatggtcggctcgctggtctcggttcgctgccggcggacacgctgctgttcacccagaggctgccccgggtggccgctcga

SEQ ID NO: 4489 - DNA, 685 bp, Homo sapiens
aatcttttttactcctcactgacttgaagctcaaaactttcctatttagcttctaatcacacactctctcttttttttttttttttttgagaaggggtctcactgtgttgccctggctggtcggtctcaaacctctggcctcaagccatcctcccatctcatccttcccaatagctgggattacaagtatgggccatcatgcctgagtaaattcttaataaatgctttctgaatggatggacggaagtatgaatgaatggcgaagtgaatgaaggaatcaacttctttctccttagtgggtgtgtgtgggcacagcaggctgaccctcgcctgtcagcgaacccaccccctcctccccggcacagggagctacagctctgtgtgtctctcttcaggctcctcgagctcctggatcttttggggcagcgccttcttccagaactggagcctgtgggccttcagagcccggcccaccgcaggctgtaggttcagctgcaggtattgctcctcctggtcgaacagcggccagtgtggcagaccctcgccattggggttcccatttctcgcaaagttggcccagtacttcatcatcttcctgcttagctgctcctcttcctcagtgaatttaaatgtagtgccccccaaagaaacttctgaaaacaaaaggaagctcatcaccatggtc

SEQ ID NO: 4490 - DNA, 643 bp, Homo sapiens
  misc_feature (1)...(643): n = A,T,C or G
ctcttgtgcttggccgcccttttttttttttttttagaatttatttttattctttcagacctctcagggatgaacggacataggcttctaacacttaggtgtgggcaacattcttcgaagcacctccctcaaagtggaaaaggcctgggggctcagacgagagaagagagaaggcagggagaaggtggaggtgaggaagggaggagggggcccagggctcagtggggtgttggggagggtgggattccaccggggtttgcccatccacagctcagtggggggatctatggagtgtgtctagcaagagaggacccatggcaggcttggtaactaacatcatgcagtagcttcttctattctctcttatttttttggaaacggagtctcgctcttgttgcccaggctggagtacagtggcacaatctcagctcactgcaacctctgcctcccaggttcaagtaattctcctgcctcagcctcctgagtagctgggatcacaggtgggcaccaccactgtgcccgtctgatttttgtatttttcatagagatggggtttcacnacgttgggcaggctggtctcaaactcctgtcctcaggtgttctgctcacncttgacctccnaaaagtgctgggattaggggca

SEQ ID NO: 4491 - DNA, 703 bp, Homo sapiens
ttgaaggaatcaacttctttctccttagtgggtgtgtgtgggcacagcaggctgaccctcgcctgtcagcgaacccaccccctcctccccggcacagggagctacagctctgtgtgtctctcttcaggctcctcgagctcctggatcttttggggcagcgccttcttccagaactggaagcctgtgggccttcagagcccggcccaccgcagggctgttaggttcagctgcaaggtattgctcctcctggtcgaacagcggccagtgtgggcagaccctcgccaattggggttcccatttctcgcaaagttggcccagtacttcatcatcttcctgcttagctgctcctcttcctcagtgaatttaaccatggtctgccttcatgtgcggtggcctgatgttcttgagccagctgggctgatgctggaactcgtagaagtacacaggggcccgggaacactgaaaatgtgctacttggagtgcagggatcacaaacatggagtccgccatcatctcctggaactgcgcttggagggtatggggatccccattgtccccaatgtactcctccctcagcaggtcaccaaatgtagggggcaacatcagcagcgttaacattttctgcagagcagcctgggaggcctctctgtccattttcttctgggtatcataaatcctcatgacctttgggataagccagcga

SEQ ID NO: 4492 - DNA, 477 bp, Homo sapiens
  misc_feature (1)...(477): n = A,T,C or G
agaatttntttttattctttcagacctctcagggatgaacggacataggcttctaacacttaggtgtgggcaacattcttcgaagcacctccctcaaagtggaaaaggcctgggggctcagacgagagaagagagaaggcagggagaaggtggaggtgaggaagggaggagggggctcagggggtgcaaatcgcagcggacctagaggtggcttggcaaatggaattcccaggaaggtttggaccccggcattggcgcccttcacatggacaagactccccagcacctgccccgtgtgtgtggtccggatgggactggctgagtcctgggccctggccccgcgacaagaagcagcagaagcccacaggccaccgcgtttcagccgcgcaacgaagtattgttgcagccgcttggtccgttccgttggtttcggtttcgttgcccggcggacacttgctttttcacccagaggntgcc

SEQ ID NO: 4493 - DNA, 677 bp, Homo sapiens
  misc_feature (1)...(677): n = A,T,C or G
cctggatcttttggggcagcgccttctcttccagaactggagcctgtggccttcagagcccggcccaccgcagctgtaggttcagctgcaggtattgctcctcctggtcgaacagcggccagtgtggcagaccctcgccatttgggttcccatttctcgcaaagttggcccagtacttcatcatcttcctgcttagctgctcctcttcctcagtgaatttaacatggtctgccttcatgtgcggtggcctgatgttcttgagccagctgggctgatgctggaactcgtagaagtacacaggggcccgggaacactgaaaatgtgctacttggagtgcagggatcacaaacatggagtccgccatcatctcctggaactgcgcttggagggtctggggatccccattgtccccaatgtactcctccctcagcaggtcaccaaatgtaggaggcaacatcagcagcgttaacattttcaagaggcaggttagactggatgccaggggcagggaggaggtggtctcgggcttggggatggcacaggaagggggagcaaaggcgaggctctgaggtgaccccacccctaaanacanacanccaggcctttgctcatgggggtcactacataggaagggtatctgggggttgaatttcctctgtctcaggacaggagaggag

SEQ ID NO: 4494 - DNA, 674 bp, Homo sapiens
tggcatgagttccttcgacggcatggcaccgccgggcccctccaaaggcgcagtatattcctcggtgggcccctctcgtcggaataatgtggcccccaaagaactcggaaccaagggacgtcatcacatgtcgccctcatgtgcggtgcccaaagttctgaaacaagctggtctgatgctggaactcgtagaagtacacaggggcccgggaacactgagaatgtgctacttggagggcagggatcccaaacatggagtccgccatcatctcctggaacggcgcttggagggtctggggatccccattgtccccaatgtactcctccctcagcaggtcaccaaatgtaggaggcaacatcagcagcgttaacattttctgcagagcagcctgggaggcctctcggtccatttccatctgggtttcatagatcctcatgaccttggggatgagccagccgaattcattgtgttgacaccaacaatgctagggacaggctgaaagtcggcagagcccagcagctcctgggggtgcctgggcagggagaccccattcaccactccggggatcatcttgaaaggctttgttaatttgccaaggatctcctctttactcttgccccccagccagcccaccaggcctcagagtcaacttggtcacaggcagacaggttggc

SEQ ID NO: 4495 - DNA, 371 bp, Homo sapiens
agcgccttcgttccataactggagcctgtgggccttcagagcccggcccaccgcaggctgtaggttcagctgcaggtattgctcctcctggtcgaacagcggccagtgtggcagaccctcgccattggggttcccatttctcgcaaagttggcccagtacttcatcatcttcctgcttagctgctcctcttcctcagtgaatttaacatggtctgccttcatgtgcggtggcctgatgttcttgagccagctgggctgatgctggaactcgtagaagtacacaggggcccgggaacctgtggggtggacagcccatgacacggtggcccctccccctgaagacttcttgcctcacccatggtgataagata

SEQ ID NO: 4496 - DNA, 588 bp, Homo sapiens
gagactgggtctctctctgtgatctcgccactgcactccagcctgggtaacaaagcaagaccctgtctcaaaaaaaaaaaagaaaaaaaaagaaaaaaagaaaattaaactagacaaattcttaagcctgtctctctttttttttaatagtcttatatgaagactattacttcatttcctgtgttttgtgttaagatgagctttaaagcaactctgaaaaagaagagggtgcctataagtaattcatagactgtttaaacaatagtagaggatctaagcatagatcccaagaggtaaagggaatctttatcactttgggaacttttactgataaatagaaattactgtcagtacagtccacaaatatgttgtttatcagccatctttcctccctgtcttcctctagcactgtagcctgtgttccccagaaaatatagtcaataaaattcaacattctttactagcttactctaatttgtggttggccataaagtattcctggtagagataatagagataatatttaactggccatgagaaaggaaacactatcgtatatgatacacccctttttaaacacattccaac

SEQ ID NO: 4497 - DNA, 807 bp, Homo sapiens
  misc_feature (1)...(807): n = A,T,C or G
ttcttttattaaaacagctttattgagatatgattcacataacatacaattcacccatttaaagtgtacaactcaaatttgccatttaaaccatgtttaagtgtaaaattcagtgacattgattacatacacaatgatatataatggttgtcaccacctatttccaaaactttttcatcaccccaacggaaactgtaatcattaagcaatatagctctcctattcccccagccctctaatgtggctttctgactccatgagtttgctttttgtagatacttatataaatggaacgctacaatatttgtccttttgtgtctagcatattaacgaggcagggatcagggatctagtgtatcttattcattgctctacccactgcaacctaactcagcgtacacagcacacagtacatgctcaacaaatactgttgaataaactaatgaattataagcaagtcacctaactttaaaaaaattttatattgtatcaatctaaggggtacaagatgtttgaaggtatacatgatgttttgatatacatatacatagtgaaatgattatagcagtcaaacaaattaacatattcatgggtgtgtgtgataaaaactgtagaaatctactctcttgacaaattttcagtacacaatacaatattactaactataatcctcattctgtatattatatccctagacttatgcagcctatctaactgcaaatttgtataccctttagcctgcctcttcctatttcctcctctcccccccactgaatcactatcctactctctgtttctagttattcn

SEQ ID NO: 4498 - DNA, 891 bp, Homo sapiens
gtgagcaacaaggctgtttatttcacctgggtgcaggcgggctgagtccgaaaagagtcagcgaagggagatagggatggggccattttataagatgtgggtaggtaatggaaaattacagtcaaagggggttgttctctggtggccaggggtgggggttgcaaggtgttcagtgggggagcttttgagccaggatgagccaggagaaggaatttcacaaggtaatgtcatcagttaaggcagggaccagccattttcacttcttttgtggtggaatatcatcagttaaggtaggaaccagccgtctggatgtgcacatgcaggtcacaggggatatgatggcttagcttgggctcagaggcctgacacacagcattattacaaacacttaggacacagaggtatccattcatggatttctttccctttaccaaggtatgagttcctcaaggatgtgctgctatgtatattatccatccttgaatgcgtagctggggacctggcatgtgaccgatatccactgaacatccgtgaagtgaaccgaagtcgatgtttagtagccaggtaggagcagcgagggcgtcacctggcagttctcattctaaagaagatggtgtagcctgggagggtcatgaatcccactttgcaaccaaccttccctcagaagagagagtctgggacaccctgttctaaccttcggtggacttccgcatggcatttagaccattccagatgacttggtctatgctctctgtccttgagatggctcttttactgttttgtatgcacactacatctccccagttagtctgtaagctttacttgggcaggaaagacgaccgttttgtgtctttctgtgtctgcctcagtacagagctcctggggacctcc

SEQ ID NO: 4499 - DNA, 655 bp, Homo sapiens
  misc_feature (1)...(655): n = A,T,C or G
tttttttttttttttttttttttagagatagggtcatgctatgttgcccaggctggtctcaaagtctgccaggattacaggcataaaccactgtacccggcccatgttgataactttttatgatacaaattcatcttctggtgaaaaccagtgaatgacaaatacttacctggtagtttaagtctatatgtgaagatgctatgtttcaagaatcaagttttatgtgatttttgtgtttaaaaactttcaattaaaaaatcttgaaaactgaagagattctctccttcatcacataaaactggggattccagcattttatacaggttctgcttgaattcctacatctcctatgctaattaagagtgctctctccctgtcccatctgtgcagacttctaaatcactagagagatcaccaggtagaatgtcagcacagctatcctccaagcctaagattagttgtcacttagtgaatgaggctcaagagagcaatagagactgagtcaggcactctgttgtaaaataggcacattacaaggtcagagaaagctgtcagtaaaaatatgtgtgattggaagggcctcaaaatgccttacaacagcttgatgctcatctgagcttgaagcnggcctgatggaaacgctaaggggatcgtc

SEQ ID NO: 4500 - DNA, 580 bp, Homo sapiens
cttcaggggcctggagttggattaagtgaaatgcacttatgatatggctgcactgtaatatactttataaagtatgcagagaaaagctttaggtctctggaatattcacaaatataaatgaacagtgttaccctacagtagtctgtaggtatctatcctctaagtattagaagatctagcaaattttaggggggaaattggaaattaattaaggccaccaggaaaaaaaatacgataaactccatttttaaaaagtaggtattgaggctggggtgcagtggctcacccctgtaaccctagcactttgggattacaggcatgagccaccacacttggcctaaattttgttttttttttcttcaggggcctggagttggattaagtgaaatgcacttatgatatggctgcactgtaatatactttataaagtatgcagagaaaagctttaggtctctggaatattcacaaatataaatgaacagtgttaccctacagtagtctgtaggtatctatcctctaagtattagaagatctagcaaaatttaaggagaaattgaaaataattaagacaacaggaaaa

SEQ ID NO: 4501 - DNA, 444 bp, Homo sapiens
caggggcctggagttggattaagtgaaatgcacttatgatatggctgcattgtaatatactttataaagtatgcagagaaaagctttaggtctctggaatattcacaaatataaatgaacagtgttaccctacagtagtctgtaggtatctatcctctaagtattagaagatctagcaaaatttaaggagaaattgaaaataattaagacaacaggaaaaaaaatagataaactcatttttaaaaagtagtattgaggctgggtgcagtggctcacccctgtaaccctagcactttgggaggccaaggcaggaggatcacttgaggccaggagttcaagactagcctcctgggttcaagcggttttcccgcctcagcctcccgagtagcaggaattacaggcacccaccaccacgtctggctaacttctgtacttttaatagaa

SEQ ID NO: 4502 - DNA, 2337 bp, Homo sapiens
tttttttttttttttttttttttttttttttttttttttttttgctttttacaaagacatttattttccccaaaatatacccccagtttacaaaatccctccgagtcccacatttaaattagaagtcctcacatcttccattcctggggcagggagagatgacatccggaaggcatcagaacgtctgaagtctcactctaccagaggccaggagctggccagaggcaagccaggaaaagactgccccagccccagaatagcaccatggtgggggtggggggcagtcccctcggtgtccccaaagcattcctggccctgccctgccccaggctctgccttttctgctgctatgaaaggtccagagggccttggtgcctgcccacctgcccacacctggacagacattttggacaccaccagattctctagccgtggcgaggggctatgtccctctctccaggtttccgccccaaccccatgctctgggtaagaattatgggtgggatgggggtgaggtatccaggaagccttgagccacagaggaggtgtggagcagggagccaggcaggagccccctgcaaaccgcagggtgcagtgtagttagttgtctgtctcccagctggatggggagtccttgagggaggaactttatcttcccacgcagggcccccagcacctaacacagtgctgacatctgtagttgctcaataaacatcaactgaatggatacatgaaaagaaaggaacaaagaggtgagaaggcagagggacagaagcctgacccccaggggccccatcacagacccctggagaaccagtgtgaccagcacatgcttccgtggggaggatgggcaggggagaggggcactgcagaggaggctgggccaggggggaaccacacgtgttccagcacgtgcacctgcaggtcttccatgcacagctgtgcatgtggtgggcgcagagtgccctgtcttcacttggggcagggagggaaaaggccagtattaaggctagagcaagaggaggaaggaggggaaaggaaacagcttctagactccaggagatgttgaggctgcactgtccctgtctgagaagaaaagattctatgcaggtggaagcagggctgaacatgatcactagtgtatcacggccattggagaaacaaggccggggtgactatgcatcgtgtctttggtgaaataaggcagggggtcagtcagtctgaatattgcatcttttggagaaaaaaggcagccagatggtccacgcagcactggaaagaagagggtggtgaaatgtggttcagtgtaactgtgtccccctaaagaaatgtatgtaactgtgaaaataaggccagcaggccaggatgacttaaaagaactaaaggttgtgggtggtctgttcattgtgtctataagaaaaaaggcagcaggatgacttgggaatcatgtccattggagaaataaggctgcacagtggtctgtgtatcgcatcctttggagaaggagcccacctgtcagagcaggatgcatctgttgggggcagggctcacagtgcagccccattgcagccagagggtaggagctgtagggaggggtagcagctccctggtcctcatggtcaggctatttcttgtccatcatcttctttgctgtcagagtgtttcagaggctgcagggctgtcttggagccttctccctccccatcctggtcctcagctcctgcattctcctcctcacagctctgtttgatctttctccagcacacgaaagccagggccaccagcagtgcaatgagacagacagacagccccacggtcaccacagggcctctggggggaatgtcataggctgccctgtgatggtgacagagccgtgcgcatcctgctgcagcacggggttgcgaaccaggcacgctgtaagtgccattcgcacccagcaccaacccgcaggaacgctgtgcacatcaaacaagccctgctcgttggccatctgcgacgtggtcacgttgccagtcagggcacaccctgcccatcctgccagaacacctcagccttcagggtagccccggtagctggagcacgtgatggtcaccgtgtcccctggccgcaggtccttgttgggctccagggtcatgctgggcttcgagtagggagcggccacctgcaggctgacggcagcgctgccgaaatcccggatgctcacgaagcaggtgaagctgccctcgtccgccacacgcacgcgctgcagcctcagggatgcattgccttgtgccagcaggtccgggaagagggccgtgcggttggcatagcgctgccctggtcccggcttcggtgaaa

SEQ ID NO: 4503 - DNA, 429 bp, Homo sapiens
ttctttttacaaagacatttattttccccaaaatatacccccagtttacaaaatccctccgagtcccacatttaaattagaagtcctcacatcttccattcctggggcagggagagatgacatccggaaggcatcagaacgtctgaagtctcactctaccagaggccaggagctggccagaggaagccaggaaaagactgccccagccccagagcattcctggccctgccctgccccaggctctgccttttctgctgctatgaaaggtccagagggccttggtgcctgcccacctgcccacacctggacagacattttggacaccaccagattctctagccgtggcgaggggctatgtccctctctccaggtttccgccccaaccccatgctctgggtaagaattatgggtgggatgggggtgaggtat

SEQ ID NO: 4504 - DNA, 429 bp, Homo sapiens
tttttactatgcttaacgtttatttctgtgtctttggttttaagagtaaattctagttaacatgaccttcagaaactcctggaaacatctgaggcgcagtggggtggaacaaggaaaaaggtccttagacttcagcgtcagtttgtggaggtctcagtcctgttggccttgacagacttggtgactcaggaccacgctgactagggctccttcaaggccctgagctgatgtcctgtgtccttggaggctgagaagggctggtgggctctgaaagcacaggaaaggggcaatccggggtggcgtcatggaatgggtgtggtctaagccaggtctccagataagggcattctgcctcttccttctcttgtcgcctctcacatttcttgcagtttatcttgtcagagtgagctgtgccttgctccagccttg

SEQ ID NO: 4505 - DNA, 420 bp, Homo sapiens
tttactatgcttaacgtttatttctgtgtctttggttttaagagtaaattctagttaacatgaccttcagaaactcctggaaacatctgaggcgcagtggggtggaacaaggaaaaaggtccttagacttcagcgtcagtttgtggaggtctcagtcctgttggccttgacagacttggtgactcaggaccacgctgactagggctccttcaaggccctgagctgatgtcctgtgtcctgggtaagggcagcatcttctgtcttgtggtgaggcttctaacacagaagtcattctcgagttccttcagtgtccccatcctgacattctgttcattatcaggtcctgtccatccttggaggctgagaagggctggtgggctctgaaagcacaggaaaggggcaatccggggtggcgtcatg

SEQ ID NO: 4506 - DNA, 544 bp, Homo sapiens
ttttatgagctccacttggcctttattacaggcagatttttaaaggcaaaaaaggagggggacaaggattggactgatacaaagttctgccgcggattctcattgatttacagaaataacattgattagtgattggctacccattgttaagccttagagtgtgggatgttgtgtccagtgaggtgttattaggttaattcatagctacttgtggcaatagcaggcagttttgacagatgaatacatagctctaaagggggagaataagatgtgattgccgtatcatttgaatgcttctctgggcctaataatttgaaagagcccacattcctcgataaaagttcttttctttccttgggattaagttagatgataaatttacaatgtttagcatgccgatttatatgtattaagtattcataaagtgttattccatgtgctgagcgaggggaacaccctcccacgtgctcccatgagccctatttctggcagatgtaaagattttttttaaatggctttttttggccacatctaggaagtaaga

SEQ ID NO: 4507 - DNA, 880 bp, Homo sapiens
  misc_feature (1)...(880): n = A,T,C or G
ttttttttttttttttttttttttttttttttagagatagggtcttgctttgttgcccaggcttgtctcaaactcctggcttcaagggatcctcccacctcggcctcccaaaatgctgggattacaggcacaagccaccacatccaacctccctcatatttgactaagaagtctcataaatctgagaacacctagcaaggaattaaggcgagggtgtggcactgttctggcttcagtctatcaccaggcagagtccacgcattcttcccagggagaaagaagcagtgacagctcttgggctttgagggaaatgattcagcgggagaaagaaggtggagaggggctaatatgcagataccattgctgcaggtggctctgcccttaaagcactgaggagggcactggtccctctggccccacccagccttcaccccaaggtgaagtacgctttctcaggtccccaaggatgggtggccaggtcccccactgggagtggaggtctcactcccttccttgggttctgacctccacattatctggctgtgagggtgacctgcctggctttccccaccaagtgcagctccccgcagctgaaagccacactctcaacacaggactcctgagatctgacactggccaattcacaccctgcttgaagctggcatttgagaggccttcaggttgacaacagcagcaacaagtttgctgttcaaagtaggccaagtcaccggctttgagcggcatcatttgaaaagtgctgggatcagccaggcgcagtggctcactcctgtatcccagcaccctgggaagccaacgcaggtggagcacctagggtcaggagttcaagaacagcccggnnnacatggagaaaccccgtctc

SEQ ID NO: 4508 - DNA, 422 bp, Homo sapiens
  misc_feature (1)...(422): n = A,T,C or G
gaacctcccaaaataacctggnctgtnaaggntgaccctnccctggcttttcccccaccnaagtggcagctcccccgcaagctgaaagccaacactcctcaaacagaggacccctgaagatctgacactggccnaattcacaccctgcttgaagctggcatttgagaggccttcaggttgacaacagcagcaacaagtttgctgttcaaagtaggccaagtcacggctttgagcggcatcatttgaaaagtgctgggatcagccaggcgcagtgttgcctttttgagatacttttttcaaagctaccctggaacggtaatacaataaaactagtacctgtgcataaattgttaactgacctgcccagcatgggtacctaactggggtttagggtagggggacagagggctttttaagattgg

SEQ ID NO: 4509 - DNA, 518 bp, Homo sapiens
ttttttttttttttttagagagagagtcttgctatgtagcccaggctggtcccaaactcctggcctcaagtgatccacctgcttcagcctcccaaagtgttaggattataggcatgagccatataatgctaacacttttttttcttgtatttttcggtacagatggggtttttccatgttgccaggctgatcttgtactcctgagctccggcaatccactcacctaggcatcccaaagtgctaggattacaggcatgagccacagcatctggccagcccagaatcaatttttatcataagttatttggatacagatgacttcattaaaaaaaaaaaagcagcattaattcatgtataaatagtgatcctgggtcaagaactcaaaatttctattttaacttatgcaaaaaagcctccaaagcctcataaaaacatcttactgtgactttatgaaaatattttacacgtaagaactggtttataaaaatacaaatcagaaatgactgatccttacattt

SEQ ID NO: 4510 - DNA, 2110 bp, Homo sapiens
ggatccaagctattgtcctgcccatggcttcccatctcaggacgctctctggccgctatcatcccagcagtggagttcagcccactactctgaaccagccgcaggtggctgctatgggactgaagccatgaatggtgccggccctggccccgccgcagccgccccggtcccagtcccggtcccggtcccggactggcggcagttctgcgagctgcatgcgcaggcggccgccgtggactttgcgcacaagttctgccgtttcctgcgggacaacccagcttacgacacgcccgacgccggcgcctccttctcccgccacttcgccgccaacttcctggacgtcttcggcgaggaggtgcgccgcgtgctggtggctgggccgacgactcggggcgcggccgtgagcgcagaggccatggagccggagctcgcggacacctctgcactcaaggcggcgtcctacggccactcgcggagctcggaggacgtgtccacgcacgcggccaccaaggcccgcgttcgcaagggcttctcgctgcgcaacatgagcctgtgcgtggtggacggcgtgcgcgacatgtggcaccggcgcgcctcgcccgagcccgacgcggcagctgccccgcgcaccgccgagccccgcgacaagtggacgcggcgcctgaggctgtcgcggacgctggctgccaaggtggagctggtggacattcaacgcgagggggcgctgcgcttcatggtggccgacgacgcggccgcgggctccgggggctcggctcagtggcagaagtgccgcctgctcctgcgcagggctgtggccgaggaacgcttccgcctggagttcttcgtgccgcccaaagcctccaggcccaaggtcagcatcccactgtcagccatcattgaggtccgcaccaccatgcccctggaaatgccagagaaggataacacattcgtcctcaaggtagagaatggagccgaatacatcttggagaccatcgactctctgcagaagcactcgtgggtagctgacatccagggctgcgtggaccccggtgacagtgaggaagacaccgagctctcctgtacccgaggaggctgtctggccagccgcgtggcctcctgcagctgtgagctcctgactgatgcagtcgacctgccccgccccccagagacgacagccgtgggtgcagtggtgacagccccccacagccgaggtcgagatgccgtcagagaatccctgatccacgtcccgctagagacctttctgcagaccctggaatccccgggcggcagcggcagtgacagcaataacacaggggaacagggtgcagagacggatcccgaggctgaacccgagctggagctatccgactacccatggttccacgggacactgtcccgggtcaaggctgctcaactggttctggcaggggggccccggaaccacggcctcttcgtgatccgccaaagtgagactcggcctggggagtacgtgctgaccttcaacttccagggcaaggccaagcacctgcgcctgtccctgaacggccacggccagtgtcacgtacagcatctgtggttccagtctgtgcttgacatgctccgccacttccacacacaccccatcccactggagtcagggggctcggccgacatcacccttcgcagctatgtgcgggcccaggaccccccaccagagccgggccccacgccccctgccgcgcccgcgtccccggcctgctggagcgactcgcccggccagcactacttctccagcctcgccgcggccgcctgcccgcctgcctcgccctccgacgccgccggcgcctcctcgtcttccgcctcgtcgtcctctgccgcgtcggggcccgcccccccgcgccccgtcgagggccagctcagcgcgcggagccgcagcaacagcgccgagcgcctgctggaggccgtggccgccaccgccgccgaggagcccccggaggccgcgcccggccgcgcgcgcgccgtggagaaccagtactccttctactagcccgcggcgccgcccgggtgggacacgccaagctcttcagtgaagacacgatgttattaaaagcctgttttagggactgcaaaa

SEQ ID NO: 4511 - DNA, 463 bp, Homo sapiens
  misc_feature (1)...(463): n = A,T,C or G
tcagtggcagaagtgccgcctgctcctgcgcagggctgtggccgaggaacgcttccgcctggagttcttcgtgccgcccaaagtgagttaccccataatcccacctagcctggggggaccagaggaggcacctgggcagcagctgagggtgccagggactgcctttggggaccgcgtggtctaatctggttgacagggtgaagtatttggtgccaggaccctgggaggtgggcctgtcatgcctcttgaacaagtcaccccttcaaccccggttcttcctttgcgaggaagggtcctctggctacaccaaagggttctggggcactaattttttcttttcgtgtgtgtgtgtgtgtgtgtccgtgtgtgtgtgtgtgtgtgtgtgtgtgcgcgcgcgtgtgtgggtgacagagaccctgtctcanaataataataaaatagggcccatgtaaatccttttaaa

SEQ ID NO: 4512 - DNA, 522 bp, Homo sapiens
ttttcatgtgtgaaatgaacttgatttaatcccagtccattatcaaatttgcttatcaaatatttccatttaagaactttaaggagcaaaggaaaatgagtatttcctgggacagccagaagtactgtgcatccaacctattttcttcttttgggaggggggtacatatgataatttagtacattcatataatttataaagaacaaatcactgtacctgggatatctaacaccctaaatatttgtcttttctttgtgctagaaacattcccaacctattttctgaaattgcttgtatttcacttcccacaattttggggatctcataattctagtccataaaatgtcagtgtttaccctaaaggaacaaaacaaaacaaatgtaaactcctggatttgttttagaacaaagataccgtcaaatcctaaagggcagctaaattctattctttggcaagtgaattttaacagctgtacagcatgtcaatcccttctaaaacaaggataccttaaaaacaaacca

SEQ ID NO: 4513 - DNA, 866 bp, Homo sapiens
  misc_feature (1)...(866): n = A,T,C or G
gnnttcggccacgagccggactccatcgactcccccggctcttagactaaaatcatgcccaagttcaaacaacgaaggcgaaagctaaaagccaaagccgaaagattattcaaaaaaaaagaagcctctcactttcagtccaggctggtcttgaactcctcacctcgggtgatccacccatctcagcctcccaaagtgctgagattacaggcgtgagccaccacgcccggccagagatccacatctatatttataacacatttatggatgaaaattaaacaggtgtccgggtgcggttgctcatgcctgtaatccgagcacttgtggaggccgaggcaggcggattacttgaggtcaggacttcgaagccagcctggccagcatggtgaaatcccatctctactgggaatgcaaagttagccgggtgtggtgtcacgcacctgtagtcccagttacttgaacctgggaggcggaggttgcagtgagccgagattgcaacactgccactccagcctgggtgacagagcaagagaccctgtctcaaaaaaaaaaaaaaaaaaaaaacctcgagggggggcccggnacccaaattcggcctatagtgaggggattacaattcacttggccggcgnttnanaacggcgtgactgggaaacctgggtacccaacttaancgcttgagnaaatccccttngcaactggggaaaatgggaaaggccgnaccggtngccttccaaaagttcngcncctaaattggnnatggnnaatttnaacgggaaaaatttggaaaaattccgggnaaanttntggaaaancngccatttttaaacaaaanngncggaatngggaaaccccntaaaanaaaa

SEQ ID NO: 4514 - DNA, 1198 bp, Homo sapiens
cagcccggactccatcgactcccccggctcttagactaaaatcatgcccaagttcaaacaacgaagacgaaagctaaaagccaaagccgaaagattattcaaaaaaaaagaagcctctcactttcagtccaagctaattacacctcctcctccaccaccctcaccagaaagagtcggtatttcttcaatagatatatctcaaagcagaagctggctaacatcatcctggaacttcaattttcctaacatcagagatgcaataaaactttggacaaatagagtatggtctatatacagctggtgccagaactgcataacccagagtttagaagtattgaaagacaccatctttccatctcgtatctgccaccgagaactttacagtgtaaaacaacagttttgcattttggaaagtaaattatgcaagctccaggaagcactgaagaccatctcagaaagttcttcctgtccaagctgtggtcaaacatgtcacatgagtggtaaacttacaaatgtgcctgcctgcgttctgatcacccctggagactccaaagctgtgcttcctcccacactgccacagccagccagccattttcctcctcctcctccacctccacctctgccacctcctccaccaccactagcacctgtgttgctcagaaaacccagtctcgctaaagcacttcaggctggaccattaaaaaaagatggacccatgcagataacagttaaagatctgctgactgtaaaattaaagaagacacagagtttagatgaaaagaggaagcttataccatcgccgaaagcacggaatccactagttaccgtctctgacttgcagcatgttaccctgaaacctaactccaaagtgttatcgactcaagttacaaacgtcttaatcactcctggaaaaagtcagatggatctgcggaaactgcttagaaaagtcgatgtagagaggagcccaggtggaacccctcttaccaataaggaaaatatggaaacaggaacaggactgactccagtgatgacgcaggccttaaggagaaagtttcagctggctcaccctagaagcccaactccaactctgccactttctacaagcagctttgatgaacaaaactgatgccaactctgcctcactccatgagatgatccacccatctcagcctcccaaagtgctgagattacaggcgtg

SEQ ID NO: 4515 - DNA, 349 bp, Homo sapiens
gaaactgcttagaaaagtcgatgtagagaggagcccaggtgaacccctcttaccaataaggaaaatatggaaacaggaacaggactgactccagtgatgacgcaggccttaaggagaaagtttcagctggctcaccctagaagcccaactccaactctgccactccagcctgggtgacagagcaagagaccctgtctcaaaaaagaagaaaaggaaattaaatgggtagtgacgttaagagatatatatcagcttctagtaaaagttttttttgttaaacctgctagctacatttacattatgtagaaataaagggaataatcactgagaataaaaaagaaaaagaaaa

SEQ ID NO: 4516 - DNA, 871 bp, Homo sapiens
tttttttttttttttttttttttttttttttttctttacaaagataatctttattcataatcacaggccacaggggtgagacctgaggtttgggttctgtggtgaaggagaacccctgtcctcctgtcccttgccctgggcctctgctggctgaggagggacaaggtgagggggcccccatggtgctcagacaaccagagcctccctggcagggcaggagtgtgggtgccacagagacaagccccttgcagagctgacctggagcccaccatccccatagcctgtgtgagcatgaagcgaggacccccgggtgggctgtgccctgggcttgtcactgatgccagtggaggctggcacctgcccctctcggcacctgagacagtgagggaaggtagctgctgccgtgaagaacaaagatgctctgagcacacacttgctggggctgagctgaggggcacacggaggcaggccctgcccgtggtctggtcagctgtccctgccgccgctacttttctggtctggggctgtagccttggtcaggttcccagcttccctcttgagaacgctgagcaaagtctgggagctctccaggatcttgaggtaggcggcctccgtctccgcgatggtccggtcgaactcgttgcgagaggcaatcttgcgtgccaggttctcgttgacgcgggccagcttctctgtcagctgcctcacctcattctgcagccgctgcttctcgtcctcctcctcctggatctgccggcacagctcctcccgcttctggcacagctcctctatgcacttgaccagctcgttgttgtagttctgcagcgccgcgccctgctgggtcatggtaaacgccgcccggggccccacc

SEQ ID NO: 4517 - DNA, 461 bp, Homo sapiens
ttttttttttacccaagcacaggagtcttgcctctgttgacccaggctggtccatcagtttctgtgtctgtggggaaaaaatatgagtcaatctaaagtatagaaggattttttttttttttttacccaagacagagtcttgctctgttgcccaggctggacagtaagagtgaaactccgtctcaaaaaaaattctagttatgctaatctggatctcagcttaattacacataatccagtattgtctcatcagtgaattgctaacacccaccctcttcacaggattaagggttaggcaggatttactaggaaaggcacaaaccctcattcaccatcaccccacccactcccttattttctcaggctggaaggttacttcaatttcccgggggggctggactttctaggggctgggttctcaggtcttaacgggagttcctatttttacccacatggcccca

SEQ ID NO: 4518 - DNA, 927 bp, Homo sapiens
gaaatttactaaggaacagaaagctctaaaacaaatcactagcctgggcaacacagtgagacccatctttaccaaaaaaacaaacaaaaaactggcccgctgtgctggcacgtgcctgtggtcccagctactcgggaggctgaggcaggaggagctcaagttgggagctgcaggaagctatgatggtgccactgcattcccagcctggagtggcagagtgagactctctcaaacaacaacaaagaaagcattaaaacaaaacaaaaacccacctcattcagggcaataattactattttgatttttcagctcacagacctacattctgcagtcttgtgtatttgagcttacaatggtacccattaaatttggctaaaacacttgggttgctgttttccctaaagaaacactattaagtcacatccccaaaacttacttagtggtcatgacgcatattagtcagtgtactgaaaattaagtattctggcccattaaaatatataaaaaattttaaaggttgtttctgtgcctgtgccatcttttattatctaattaactaaggatcttttaaaaaatctctgaattattttttgaactatcattgccatacaggtttgttttcttcaaccctatcggccctcctgagtctttctgtgctccggatagctcttttcttgtaacatcctcagtccttcaagaactacacactccttttaccctcttctctgaaaggagaccctgctctcttcattccccctcttctagcctgaagcttgctcacttcacacttctaccctcaggcacagagtcttccctcaggcccagccacagccttctccattcctgcacggccgccctcctcttctcccaggtctgtggcagcctaggtgacttccacactgatgtccatgacccagacagcctacc

SEQ ID NO: 4519 - DNA, 432 bp, Homo sapiens
  misc_feature (1)...(432): n = A,T,C or G
ttttttttttcattcaaaattttgtatattttgaaaacatttatagaaatactgaatatataacaaaatatcccctaaaatatttctgctcataagatttttccaactattatatgttctttatacttaagaatattgtcggccaggcacagtggctcatgcctgtaatctcagcactttgggaggctgaggccggcagattgcccgaggtcaggaattcgagaccagcctggctaacatggtgaaaccccgtctctattaaaaatacaaaanttagccagggcatggtggcacacacctgtagtcccacccacttcaggaggctgaggcaggagactcacttcaacccgggaggcggaggttgcagtgagccaaggaacacggccactgcactccagcctggggttgacagagttgaanttccaccttcaa

SEQ ID NO: 4520 - DNA, 476 bp, Homo sapiens
tacattatgaaaaactgaacacatttattcaatttccaacaatcaccaattagaaatgggcttaaatgacaatacaaagaaagctataagcaaacattttgacagggggatgtgaagaattagaacaaactgcttaggaaactacagtgtgtgcctgtgtttgtgtcgtgtgtgtgtgtgtgtgtgtgtgtgtgtgtgtgtctgtgatgttatcgttcttttcccctccttctaaaattaggtaaaacatttcctaaagatacagagcaaggtaagatttcttcttcagggtaatttccagcagtgggttctcgggggttgatgaggaaaatcttagggagggaaaatgcacttcattttatttttaattttagggtattgcaggatgtaccctcccataattaaggaagttttttcatctaaatactttttttcctgtataaaagggcctttatgtaatgcataccttttataat

SEQ ID NO: 4521 - DNA, 610 bp, Homo sapiens
caaaataattaccggggttgtgagggccctcagtccagaacccgggagctgaggcagattatgtggaacccgggagccaatgtttcagtaagcaagttcacgccttgcattccagcgtggcaacagagcaagactctgtctcaaaaaaaataaataaataaattatgaatgagtattttctagaaattcaacttgctaagcctgtaatacttaagggtagtttatctagatacagtactttcttccctgataagtagtatcattggagcccttaggtataggagaagaggaagaagtttaaaaagtgtaagtgggccgggcgtggtggctcatgcctgtaatcccagcactttgggaggccgaggggggcggatcacgaggtcaggagatccagactatcctggctaacaaggtgaaaccccgtctctactaaaaatacaaaaaaaaacattagccaggcgtggtggcgggcgcttgtagtcccagctactcgggaggctgaggtaggagaatggcttgaacccaggaggcggagcttgcagtgagccgagattgcaccactgcactccagcctgggcgacagagcaagactccgtctcaaaaaaaaaaa

SEQ ID NO: 4522 - DNA, 632 bp, Homo sapiens
tttttttttttttttttttttttttttttttttttttttttttacatttttctaaagaaatatttaattggtagtcttctagaaagaaggcttttcatatagtacaaaaacatgcagtcggaagcactgagaaaactgggcaacataagagaagcatgagatgtgacatgaagcagctgatagtctatgtaagtcaaaaataaaattctaagcacacaaccaactgaatcgacccttccacttggccaagagcattctaaagtaaacctgaaacactagctcaggccatgatgggaatgggtggtcagacatacctcattataccttcctctctttggaattcaggcacagtggaccagcattaacattaaaacagagaccctaagaccgacaaaaacaggctccttgtagcaacaagataacatgacagataacaggccctgagagaaatctaagtattttaccccaaaataaatttctcttaagtctgataagaaacatttacaatctattctctctgaagcctgctaccttctggcttcatctcacagtaagaaccttggtctccacaacaccttatcttaacccagacattcccttctattgattccaggtctttggataaacccact

SEQ ID NO: 4523 - DNA, 419 bp, Homo sapiens
cccaggcggtgtggtgggagccggacccgccgccgccgctgccgcagccaaagctgcttgccaaagccgcccagtttggcctagtgggagccgctgggctcggaggactcggagtcggagggcttggagttccaggtgttgggggccttggaggtatacctccagctgcagccgctaaagcagctaaatacggagtggcagcaagacctggcttcggattgtctcccattttcccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaacgggcaggccgggcctcgtgc

SEQ ID NO: 4524 - DNA, 776 bp, Homo sapiens
  misc_feature (1)...(776): n = A,T,C or G
cctaagggcnaacaattttctgacacaaatgaaaagtgcgtcatcctagggacaatcgacaccccagcctttgctnacatctacncagagcacgnccatcaggtgnttggtggcaaagtatgcgccaagcgatttctacatgccctcngnagatgtgtctggaagctgaggatctgggatacacgcagaaaggagcacntgttgaagtatgagtacagccctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacagttggcgaccacagccgctttgtcaactgtgtgcgattctctcaagagcaaaggttaatttaaggacaaagatgaagtcactgtaaactaatctgtcattgtttttaccttccttttctttttcagtgcagaaattaaaagtaagtataaagcaccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcaaaaaaaa

SEQ ID NO: 4525 - DNA, 590 bp, Homo sapiens
gagggagagagaaagaaagaaagagagagagagagagagaaagaaagaaagaaagagaaaggaagaaaagaaaagaaaagaaaaagaaagagatcacattcctccagctcactgattcaaatcctagagctctttagggaccctcttagtctctccacatctctctgatgagtaggatccatgcagaggaaatgtcaacccacctgcaatcctgcattcaggaccaactgtcacttccatactctactaaccacccttctagcccctctgaggttcccataggttaggggaacaatgctttttcttccacaggagctgctgcaggcttagtgcctggtgggccaggctttggcccgggagtagttggtgtcccaggagctggcgttccaggtgttggtgtcccaggagctgggattccagttgtcccaggtgctgggatcccaggtgctgcggttccaggggttgtgtcaccagaagcagctgctaaggcagctgcaaaggcagccaaatacggggccaggcccggagtcggagttggaggcattcctacttacggggttggagctgggggctttcccggctttggtgtc

SEQ ID NO: 4526 - DNA, 406 bp, Homo sapiens
tcgacaagaaattatcaacattatgcaggatcggctcaaagcctgtcagcagagggaaggacagaactaccagcagaactgtatcaaggaagtggagcagttcacccaggtggccaaggcctaccaggaccgctatcaggacctgggggcctacagttctgcccttccctctgctgacaggctttgagccgatcctcataaatgttgataatttcttggtcgactttgtagtccctcttccactgcatttcggcttcatacatgcacatgatgtcctcctccttgcactcagtgatgtctggcacgcggcggtactgccggtggtatgtagtaatacctgttctttgcatgctgccgctctataaattactactcacgagggtcacgggtcggtccacggtcgagc

SEQ ID NO: 4527 - DNA, 735 bp, Homo sapiens
  misc_feature (1)...(735): n = A,T,C or G
aaaaaggacttttacgtgagccatgctgggagtgtggagatctgcaccgtgtgctgctgggacactattccctgggatgccacagggtggcatgcccagattttatgggtgacatgggaggagccagaccccatggctcttgctttcaattgttctcacagggtacaggaaaaggattccttgtgattagcctctcttgctccttttctccaccagcaattttttnttttagaaattatcaacatttatgaaggatcggctcaaagctcttccagcagagggaaggacaaaactacccgccctaaccttctcacggacgtggagcagttcacccagtgtggccaaggcctaccaggtaccgctgtgcgtgccccacccacccccaaccccccaccatcctcctggagcctgggggccagaacccattgcaaatcttccctccccctcccttgtggttcaattgaatttgccccctttgcatgtagcagaggcctcggttcccagcttgtttccattgcttccccagatcaggacctgggggcctacagttttgccaggaagtgcctggccaaacaaaggcagaggatgctgcaaaaaagaaaagctgcaaaagaggccgccagctgccacctcctgaggcagcttgtgggtgcccctgctgtgtggctctgtatgactgttgctgaaatataaagccctgcaacctgaaaaaaaaaaaaaaaaaaaaaaaaaaaa

SEQ ID NO: 4528 - DNA, 2478 bp, Homo sapiens
  misc_feature (1)...(2478): n = A,T,C or G
tgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaagggcaacaattttctgtacaccaatggaaagtgcgtcatcctaaggaacatcgacaacccagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataactgcgcggcattctttgagggacccccattcaagttcaagttcacaattggcgaccacagccgctttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgctttctgcttctggggacaaaacttccaagatttgggacgtcagcgtgaactccgtggttcagcacatttcccatgggctccacggttctggaccagcagctgggctgcctatggcagaaggaccacctgctcagtgtctccctgtccgggtacatcaactatctggacagaaacaaccccagcaagcccctgcacgtcatcaagggtcacagtaaatcgatccagtgtctgacggtgcataaaaacggcggcaagtcctacatttactctgggagccacgacggacacaattaattactggggatttagagacgggggagaacgactccttcgctgggaaaggccacacgaaccaggtgtccaggatgaccgtggatgagtcggggcagctcatcagctgcagcatggacgacaccgtgcggtacaccagcctcatgctgcgggactacagcggacaaggagttgtgaaactggacgttcagccaaagtgcgtagccgtcggccccgggggatacgccgtggtcgtgtgcattggacagattgtcctgctgaaggatcagaggaagtgcttcagcatcgacaaccccggctacgagcccgaagttgtggcagtgcaccccggcggggtacacggtggcaattgggggtgtggacggcaacgtccgcctgtattccatcctgggcaccacgctggaaggatgagggcaagctcctagaggccaagggcccngtcgaccgacgtggcctactcccacggacggcgccttcctcgcggtgtgcgacgccagcaaggtggtcacagtgttcagcgttgctgaccggctactcggagaacaatgttttttatggacaccatgaaaaataaagcgagcacctaaacaatgtgtggagcataactaaaacccacagcccaaccaaaccttgagaatgcgaaacattccagaggcagtagcctccaaagcacacagagcccctggccccgccgcggctctcactatctgtcaggggaggttgtacaggtgaaatgagccggggggctcatggttccctgccttgaagaacattttctgtactaagtggagaagagggaatatgcattgcagttcagcaaagcccggaattctgtgttgaaacagatgtctgtctccctagtgtgtgactcacaccttgtgggctggcctttcagagcgccacctccagatccagatggggacacacaaacccctgggatatgttttcattgttcagattttgtgcttgattttaaaagaaagggaaatgtggggtaactttcccttttttttaaatgtatccttaactgttgccctgtcagtgttttacaaactaggtgcgttgacgggcacccgtgtcccaagtttttagaacccttgttagcccagaccgaggtgtccctggtcaccgtttcaccatcatgctttgatgttcccctgtctttccctcttctgctctcaagagcaaaggttaatttaaggacaaagatgaagtcactgtgaaactgaattctgtcattgtttttaccttccttttctttttcagtgcagaaattaaaagtaagtataaagcgccgtgaaaaaaaaaaaaaaaaaaaaaaaaaaaaa

SEQ ID NO: 4529 - DNA, 1105 bp, Homo sapiens
cggttcgcggctgcttcccaggcgcccagaccagcgaccagcaccgcgtaggcgctcggcacagaccgagaacggaggccccacgcgggggcgccctgcggcgaggcgggtcccggccgcgcccggcggagccggggaactacaagtcccatggtgcatcgcggcgccagcgcgcagacgcagccgccctcggcgtcctctgtagcgggcgacctaggccgcgggacccggacggaggtagaggccagggcagcgcgtccgggagccggagtccgcgcccgccgccgccatgccggacagctgggacaaggatgtgtaccctgagcccccgcgccggcacgccgggtgcagcccaatcccatcgtctacatgatgaaagcgtttcgacctcatcgtggacctgaccccgtgaccctcgtgagaggaatttatagagcggcagcaccgcaaagaaccaggtattactactaccacccggcaagtaccgccgcgtgccagacatccactgagtgccaaggaggaggacatcattgtgcatgtatgaaagcccgaaatgcagttggaaagagggacttacaaagtcgacccaagaaattattcaacatttattgcaggattcggcttcaaagtcttttcaggcaggaggggaagggacaggaactacccagcagaactgttattcaagggaagttggagcagtttcaccccaggtggccaaggcctaccaggacccgcttcgaggaccttggggtcctacagttctgccaggaagcgcctggccaaacagaggcagaggatgctgcaagagagaaatgctgcaaaagaggccgccgctggccacctcctggaggcagctggtgggttgcccctgctgtgtggctctgtatgactgttgctgaaaggctttgagccgatcctgcataatgttgataatttcttggtcgactttgtagtccctcttccactgcatttcggcttcatacatgcacatgatgtcctcctccttgcactcagtgatgtctggcacgcggcggtactgccggtggtagtagtaatacctgttctttgcagttgccgctctataaattctctcacgaggtcgacc

SEQ ID NO: 4530 - DNA, 28228 bp, Homo sapiens
  misc_feature (1)...(28228): n = A,T,C or G
cccggcttacaaaagaacttttaaggccaggcacagtggttcacaccttcgggaggctaaggcaggaggatcgcatgagcccaggagttggaggctgcagtgaactatgattgtaccactgcactccagccggggtgacagagcaaaaccccatctcaaaatgaaacaaaatatggactggacttcctgtccactgctcctccacagtgtcacatggcccctgccacctgtctgcttgccttgtgtccctggggcagggagacccatcgttcagaaatggaacactcattttccctcctctccccgcaggagcagcagtgcctggggtccttggagggctcggggctctcggtggagtaggcatcccaggcggtgtggtgggtgagttgaaaccccaggaggggcagggtggggagggaatctaaccagtacagagtgcctccctgaactcggtctgtgttcccaggagccggacccgccgccgccgctgccgcagccaaagctgctgccaaagccgcccagtttggtgagcactgggtggaggtgggagctgccgccaggcccccaggcccccagggtgtgggaggagcttctgaccaggcactgtagactcagagtccctgccccagacacctcctggctccactgtgccatcgaaggccaggggagacctcaggctccacctgtgtccccagaggacacctccgccctccacaggccgaggcttcagtcccacctttctgaccagcggagtctaatgctcagctgtctccacaggcctagtgggagccgctgggctcggaggactcggagtcggagggcttggagttccaggtgttgggggccttggaggtgagagttgttctgaaatcagtgagtgtgtgtggtgtgtgtatgcgagacagagatggagacagagacagagacagagactttcgttcccacccctggcacgtctttgctcaagatgtcctcttggccaggtgcggtggctcacgcctgcaatcccagcactctagtaggccaaggtgggcggatcactagaggtgaggagtttgagaccagcctgggtgacatggcgaaacctcatctctaccaaaaatacaaaaataagccgggcgtggtggtgggcacctgtatttccagctacttgagaggctgaggccagaggatcgcttgagcccaggaggcagaggctgcagtgagctgagatggtaccactgcattccagcttgggcagcagagtgagaccctgtcatctaaaaaaaaaaaagaaagaaagaaaagaaaagaggccaggcatggtggctcacgcctgtgatcccagcactttgggaggctgaggtgggcggatcacgaggtcagatcaagaccatcctggctaacacagtgaaaccccgtctctactaaaaaatacaaaaaattagctgggcgtggtggcagacgcctgtagtcccagctactcaggaggctgaggcagaagaatggcgtgaacctgggaggcggagcttgcagtgagccgagatcgcgccactgcactccagcctgggcgacagagcgagactccgtctcaaaaaaaaaaaaattatatatatatatatatgtatgtatgtatgtatataaattagctgggcatggtgacacacgcctgtaatcccagctactcgggagcctgagacaggagaatcacttgaacccaggaggcagaagttgcagtgagccaagatcacgccgctgcactccagcctgagcaacagagcaagacctcatcccaaaacaaaataaaaacaagaaatgtggcaaacgggagctggggctatcccttgccgccagggtcccagtcctccccctctcctctctctttcaacccacctgaccactgcggtgggagtaaattaggagaatgatggttatgccagttctccaagaaagaaatcaaagcttggagagaaattgctttccctaagtctccaccatggtggccgaccttgtgtggccatttccccctttcttgggctgtcattgtgtctccccctgtaaactagcctgcacagctcttcctgtgagtgccacaagaccagacacacagtaggagcttaacaattaagacttttggggccgggcatggtggctcatgcctgtaatcccaacactttgggaggcttaggtaggtggattgcttgaggccaggagttcaagaccagcctggacaatgtagcaagaccccccccccaccaccacctctacgaaatatttaaaaattagctgggcgtggtgtgtgcctgtagtttcagctacttgggaggctgaggcaggaagatcacttgaacccgggagttcagggctgcagtgagctgtgatcaagccactgcattccagcctgggcaacagagcaagaagctggatagatgaaggagagatggggggatagactgggaggatgagtccatgggcagacggtaaagggtgagtaggtcagaagacagggcctagccaggtgcagtggctcacacctgtaatgtcagcactttgggaggccgaggcaggtggatcacctgaggtcaggagttcgcgaccagcctggccaacatggtgaaacctgtctctactaaaaatacaaaaattagccaggcgtggtggtgggtgcctgtaatcccagctgctcaggaggctgaggcaggagaaccgcttgaacccaggagatggaggttgcagtgagccgggatcgcgccactgcactccagcccaggcgaaggagtgagactctgcctcaagaaaaaaaaaaaaaaaaaagacagggcctgacaggtggcattggcattcctgagccgtcatgtgcctcatctccccaggtatacctccagctgcagccgctaaagcagctaaatacggtgagttcccctctgatgccttcctgccagtggcctgcaccccctgccatgcccatcgccaccctcccccagcccagctcaggcctccctctggctccccctacccctgaagatcttgtctgggacattccttaacccagaacccagcagggatatcagggcctcttcccgatgggggtgtcttatcctgaccccacctgcctcttctcaggtgctgctggccttggaggtgtcctagggggtgccgggcagttcccacttggaggtaggggtggccagctctgctacgtagtcctcagctctgtcccgatctagagggggcctgtccatctagcagtggggactcccagagcccatgtccacacaaggacaggagactggggctggtgagggcactttaggattgcagatgtactgggcaaacgggcaagctataaggttggggacagtgccaggctgagctcagggttgaggccatgaggtgccacacctggttgctaggtggcggcatgttgtgttgagaaagccactctggctgtagtgagggggattggctgggcgtggtggctcacgcctgtaatcccagcactttgggaggcctaggtgggtggatcacttgaggtcaggagttcgagaccagtctggtcaacatggtgaaaccctgtctctactaaaaaaaatgcaaaaattagccaaacgtggtggacgcctgtaatcccagctactcgggaggctgaggcggaagaatcactggagcctgggaagcggaggttgcagtgagccaagatcgcaccactgcactccagcctgggtgacagagcaagaccccatctcaaaaaaataataataaaataaaatataaaaaattatatagtgggggggatggagaggaggtgatcccagacagaggtcttgggtgagccagtgcaggcagaaagtgatgaggctggagtcagtttccacccctaccaacccaccaacctgaaatctctcctgcaggagtggcagcaagacctggcttcggattgtctcccattttcccaggtatgccaggctccctgcccctgggccctgcctggagctgcagccacctcctccctcctctcctgtgccatctcctgctcagaagggctgagccagcacccaggggtggaccccacagcctcaggtcacacgaggctggaccccgagctgaatgtagagcctcccctccttcttgctgacctcttataaacacagggaacatttgctttttaaaaacacagttcatggccaggtgtgatggctcacacctgtaatcccagcactttgggaggctgaggagggcagatcacctgaggtcaggagttcaagaccagcctggccaacatggcgaaaccctgtctctattaaaaatactaaaattagccgggtgtggtggctcacgcctgtaatcccagccctttgggaggccaaggcaggtggatcacgaggtcaggagatggaaaccatcctggctgaaacggtgaaaccccgtctctactaaaaatactatagtcttctttttttttttgagatggagtcttgctctgttgcccaggctggagtgcagtggcacgatcttggctcactgcaacctctgcctcctaggttcaagcgattcttctgcctcagcctcccaagtagctgggactacaggcatacaccactacgcccagctaatttttgtatttttagtagagacggggtttcaccatattggccaggctggtctcgaactcctgacctcgtgatccgcccgcctcggcctcccaaagtgctgggattacaggagtgagccaccacgtccggccgtctctactaaaaatacaaaaaattagccgggcatggtggcgggcacctgtagtctcagctactcgggaggctcacgcaggagaatggtgtgaacccgggaggcggacatggtgtgaacccgggaggcggacttgcagtgagccgagattgcgccactgcactccagcctgggcggcacagcaagactccgtctcaaaaaaaaaaaaaaaattagccaggtgtggtggtgcacgcctgtaatcccagctactctggaggctgagacaggagaattgcttgaacccaggaggcggaggttgcagtgagctgagactacaccactgccctctagcctgggtgatgacagggcaagacgattgcgtctcaaaaaaaaaaaaaaaaaaaaaaaaaaaccttcagaggcagatgtctgttcctgccccactctctgctcactgccaccaggtggcggtaaggagccatatctggctcaagcagggttaggaactgctccgggccgcgctactagacaatggtgccttacctaatacagactgatgccttgaaacagggttcacccatcagactattcccaggagggggtaggaatcctgggtttgagtcccagctcagacactatgtggataagaccctctctccctctactgggccttgatttacttatctgatgccctctcagatgtatgggtccaccccactccctgagagggccgtctcctgcagacactgactctcccttcatcccatgttccttgatggagctgctcttagcctttccccgaaaggcttcttggagcagtggagccaggagccagtgccaggccccgtccttccccagccaggccccatgacctgcccccttttctgcgagcgttggtttcatccaagtaatatcttgggggcttctcccgccccatctgtccagtggaagttgatggcatggatcaggtctgagtttggcctggggccatgacttggcttctcttggcttcttggagcctccattcgagtgggtcagagcaggcggggattagagccgaaactgagaggggccggactcacagtgatgtgcacctcctcccgtccaggtggggcctgcctggggaaagcttgtggccggaagagaaaatgagcttcctaggacccctgactcacgacctcatcaacgttggtgctactgcttggtggagaatgtaaaccctttgtaaccccatcccatgcccctccgactccccaccccaggagggaaacgggcaggccgggcggctttngcagattccacaggggcaaggaaacaggagggggagcggccaagtgccccgaccagggaggccccctacttcagaggcaagggccatgtggtcctggccccccaaccccatcccttcccacctaggagctccccctccacacagcctccatctccaggggaacttggtgctacacgctggtgctcttatcttcctggggggagggaggagggaagggtggcccctcggggaaccccctacctggggctcctctaaagatggtgcagacacttcctgggcagtcccagctccccctgcccaccagggacccaccgttggctgccatccagttggtacccaagcacctgaagcctcaaagctggattcgctcatagcatccctcctctcctggggtccacttggccgtctccttccccaccgattcgctgttccccacatctggggcgcttttgggttggaaaaccccccccacactggggantagccaccttgccccttgtaagaatccatccgcccattccgtccattcatccatcggtccgtccatccatgtcccccagttgaccggcccgggcacccactagctggctgggtgcacccaccatcaacctgggttgacctgtcatgggccgcctgtgccctgcctcacccccccttcttccactccccccagggcgtgcggggctgtgcagactggggtgcccaggcatctcctaccccacccggggtgtccaccacatagcagtactgtataaccccccatccctccctcgggtccgactgaacttcagagcagtttcccatttcctggccccgcccatcttttttgtgttttcggtgttgatagatcaataaatattttattttttgtcctggatatttggggattatttttgattgttgatattctcttttggttttattgttgtggttcattgaaaaaaaaagataattttttttttctgatccggggaagctgtaatccccagtaggaaaaaccatttttaatcactctaataataactctggaatgaaaacacacctttttttttaataagaaaagagaattaacttgttcagaaatgactaataaatgaaaaacctttaaaggaaactgtgtcttagcttccttcgtatgatttaatctgccttcaactcgctggcctggatggggataagggctctgcttcagggaacctccaccacccacagtgtatttgagaggttgcccaaccaaaagcccctgctgcctggcttctggggcatcgatctttctccaagtttggcttgtactttaacaatgaggccaggagtttgagacccacctggacaacatagctgtccagtggagaatcactttgtaccatatagctacaaaaaaaaaaaaaattacccaagattggtggtggtgcatgcctgtggtcccagctactcaggaggctgaggtgggaggttcgcttgagcccaggatttcgaggctgcagtgagctatgattgcgccactgcactccagcctgggtgagacagcaagatcctgtctcgagagagagagagagagaaacagaaagagacagagaggaaagatggctgacctaagaaaatgcagaagacagtcaaaggtaaccattttcctccgaaacagtcccctctgaggaagacccactctcatgcgtggccatgtaaggccatttggcttgagaagtttaagaagtgatacccagcagcaggttcagctccacccttactcagatgcacccattcccattctggcccttcctcctccccttgaggccagaaatccgtggggcccgggaatgtgttcacctgcagcccacatccctacctctagaccacgctctggataccagatactggaattcccttccccaaccaccaagcccacttccagggctcactcagcctcaggcctgtgccaccctcctgagagcgggccccgtgctgagtgtgcacacctctaagccagaaatgtggcaacagagctgttcgtggggagtgtgggtggggctcaccatgcagactggagcatatgtgggtttgcatacgaggatccttgcgatcccagaaggagctgggagggaaagagaaagctggtggagggtatgctcagagagagcttcccagaggacagtaaagggcaaaaaacattttaccaggcaaagaatagaacagagaggagggtcaggcctttcaggcagaggacaggacaactagatgtctggtaggagagggcagtgctgaggacttatggaggatgatcaggagggggtgagcggcgtggttcaaggagatgcacaagagggttgctgtaataatccagggaggggtgacacagcctgccctagagtggtgacaaagtagatccatccatccatccatccacccatccacccacccatctgtccacctacccacccatcaacccacccatccacccacccacccaaccattcttccatccatccatgtctccttccacccatccacccacccacccatctatccacccacccatccatccatccatctatccacccatccatccacccaccagtccatccatccattcattacttcactcgacaaaaatatccattgctggtttttcctcaggtctccggcctctaaaagtcagtaagccccagcattcaggcctgtggactccctgtcttggtttctcatagcttgcggttttatttatttatcagagacagggcctcagtctttcgcccaggctggagtgcagtggtgctatcacagctcactgcagccttaaactcccaggctggagcaatcctcccaactacaggcacataccaccatacccagctaatttttaaatttttttatagagatagaatcttgctatgttgcagccaggcgtggtggctcatacctgtaatcccagcactttgggaggccgaggcaggcggatcatgaggtcaggagttcaagaccagcctggccaacatggtgaaacctcatctctactaaaaatataaaaattagccgggtgtggtggtgcatgcctgtaatcccatctacttgggaggccaaggcaggagaatcacttgaacccaggaggcggaggttgcagtgagccgagaccgtaccattgcactccagcctggcgacagagcgagactctgtctcaaaaaaaaaacaaagaatcttgctatgttgcccaggctgctctcaaactcctggcctcggcctcccaaagtgttggggttacaggtgtgagccacctcagctggttgctcgtggctttaaatatttaatacgacctattcattggtgactctccaattgacatctccagcatgaccgctcccctgagcccaggacttgcacatccaaggccaattctaacatctctacctagaaatctcatagacatggcctaggtagcgtggttttccctccctgcctttcccatctcagtaaagggcagccctactcttccagaggttccggcctgcaactctgtaaccatctctgactctgctcttccctcactccccacagcagattcaccagcaaataatacggcaccaccttcagaatatatccagagttggccaggcacactgactcacacctgtaatcccagcactttgggaggccgaagtgggcagattacctgaggtcgggagttcgagaccagcctgaccaacatggagaaaccccgtctctactaaaaatacaaaaaaattagccaggcatggtggtgcatgcctgtaatcctagctgctcaggaggctgaggcaggagaatcacttggacacgggaggcagaggttgcggtgagccgaggtcacaccattgcgctatagcctgggcaacaagagcgaaactctgtctaaaaaaaaaagaatatatccagagtcctaccacgtctcagggctaagccacaatccccagtatctcttgcctgaattactgaaatagctccctgaaccccttagttctcccctggctccccttcggccttctctccactcagcaaccaaagcaatctttttttttttttttttttttttttgaaatggagtttcactctgttgcccaggctggagtacattggcgtgatctcagctcactcaacctctgcctcccgggttcaagaaattctcctgcctcagcctcctgcgtagctgggactactggcatgtgccaccatgcctggctaatttttgtgtttttagtagagacaaggtttcaccatgttggccgggctggttttgaactcctggcctcaagcgatcctcctgcctctgcctcccaaagtgctgggattacaggtatgagccaccacatctggcccaaagcaattctttcaaagcataagtcaactcgggtcatgcatctactccaagtcctgcagtggttcctgtctcactcagagacaaagccagaggcctttctatggccaagaagcccctacttgcatggcagcagctctcctgacctcacattctgctattcgagccatgcggtcgccctggccatcttacttttccttgagtgcaacaggtcacccactgccagccttggcatctgctatctcttctgcccaaaacgccctttcatcagctatctgtgtttctggctcactcagctgcttcaggtcttgactcaggtgtcaccttctcagagtgtcctacactgacacctttctaaaattgcaaattgggctggatgcggtggcctgtgcctataatcccagcactttgggaggctgaggtgggaggatcacttgaggccaggagttcaagaccagcctgggcaacatagcgagactccatctctatttaaaacataaataaaattgcaagctgcaccctcctcctctgctcattactccctcacctggctctacctccgttttgtgttttgttttgttttttgagatggagtctcactctgtcgcccaggctggagtgcaatggcaaaatctcacctcactgcaacctctacttcccgggttcaagcaattctcccacctcagcctcctgagtagctcggattacaggcacccgccatcatgcctggcaaatattttttgtatttttatacagacagggtttgaccatgttggccaggctggtcttgaactcctgacctcaggtgatccaccctccttggcctcccaaagtgctgggattacaggcatgaaccaccgcgcccagcctgtctctgccttctttgactccagagcacctgtcaccataaacaaaatatattttacttctttgttttctgtctctctacaccagactgtaaactctaagatgggcactgctttaagaataacacagcctggacacagtggctcatgcttgtaatcccagcactttgggaggccgaggcaggcagatcacttgaggtcaggagttcaagaccagcctggctaacatggcaaaaccccaacaacaacaaaaaaaattagctgggtgtggtggtgcatgcttgtaatcccagctactctggggactgaggcaggtgaatcgcttgaacccaggaggcagaggttgcagtgagccaagattgcgccactgcactccagcctgggcaacagagcaagactgtctcaaaaaacagaaaaaaaatttttttaaagaccctatctccaaatacagtcatattctgcagtattggagtaaatgcttcaagatataaattttgaggagacacagttccacccctaagagttacctcatggaaaaagggtctttgtagttgtgattaagtcaaggatcttgagagatagggagattatcctgctgggccctaaatgctacataggtattcttatgagaagctggggctgggcacaatggctcacacctatcatcccaacactttgggaggccaaagcaggaggatcacttaagccaggaggtcaaggctgcagtgagctatgattgtgccactgcactccaatctgggtgacagagtaagaccctatctgaggaaaaaaaaaattggaaaatctagataaaatggataagttcctagaaagccacagcctgccaagactgaatcatgaagaaatagaaaatcagcatagaccaatagtgagtaaggagattaaatcagtaataaaaagtctcccaacagagaaaaacccaggaccagatggcttcactggagaattctaacaaacatttaaaaaattaacaccaatcctcctgaaactcttccagaaaactgaagtagagggaacacttccaatctccttctaagaggccagcattattctaataccaaagacacaagaaaagcaaactataggccaatatcctttatgaacattgatgcaaaaattcttcaacaaaatacaagcgaaccaaattcaatagcagattaaaaggattatacaccataaccaagtggaatttttcctgaaatgttaggatgtttcaacatatgaaaatcaatcagtgaaatataacatataaacagaatgaaagacaattacatgatcatctcaattgcaacagaaaaagcagcaagatccaataaactttcatgataaaaacattcaacagactaggaatagaagcaaaccacttcaacctaataaaggctatagatgaaagcccacagctaacatcatacttaatggtgaaagactgggcttgagtggtggctcacacctgtaatcccagcactttgggaggctgaggcaggcagatctcttgagcccagaagttcgagaccagcctgggcaacatagcgaagcctgtctctacaagagaatataaaaataagccgggcatagtggcacatgcctgtagtcccagctgttcaggaggctgaggcaggagaattgcttgagactgggaggttgaggctgcagtgagccatgatcatgccactgcactctagcctggaaaacagagtgacaccctgtctcgaaaaaaataaaaaggacttaaagcttttcctctaagattaggaataagacaaggatgcctactcctatcacttctattcagcatagtattggaagtcctagtcagaacaactaggcaaaaaaaaaaaaaaaaaaaaagaaattaaagatatccaaattgagaagaaagaagtaaaattatctctgttcacaaataacagactcttatatgtaaaaactcctaaagatcgaacatgcccacaaaattagttgtgtttccacatcctcacaatgaacaatctaaaaaggaaattaagaaaacaattccaggccgggcgcggtggctcacgcctgtaatcccagcactttgggaggccgaggcgggcggatcacgaggtcaggagattgagaccatcctggctaacacggtgaaaacccatctctactaaaaatacaaaaaaaattagccgggcgtggtggcgggcacctgtagtcccagctactcgtgaggctgaggcaggagaatggcgtgaacccgggaggcggagcttgcagtgagccaagatcgtgccactgcactccagcctgggggacagagcaagactcaaaagaaaaaaaggaaacaattccatttataatagcatcaaaaagaataaaatactagaaataaacctaaccaaggaagtgaaagatttgtacactgaaaactgtaaaacactgctgaattaaattaaagaagacacaggtaaatataaaaatttacatccatgttcatggatggtaagacttaattgttaagaggcctgtagtactcaaaacaatctacggtttcaacacaattgccatcaaagtcccaatggtattttttgcagaaacagaaaatttcatcttaaacctcatgtgaaatctcaagggactccaaatagccaaaacaattttgagaaagaagaacaaagttggaggactcacactttgtgatgccaaaacgtattacaaagttacagtaacccaaacagtgtgatactggcataatgacagacaaacagaccaacagaacagaatatttataatggctcagaaatattaataaagcctcgtgtatatgattaaatgatatttgacaagatgctaagaccattcggtggggaaagaatagtctcttcaacaagcagtgttagtggccagacacagtggctcatgcctgtaatcctcacacttctgggaggccaaagtgggaggattgtttgagcccaggagttcgagaccgccctgagcaacatagacagatcccatctctctttaaaaaaacaaaaaacataacaaaaaagccaaattttattgggaaaactggatatccacatacaaaagaataaagtggccgggcacggtggctcatgcctgtaatcccagcactttgggaggccgaggcaggtggatcacctgaggtcaggagttcgagaccagcctggccaatatggtgaaaccccatctctactaaaaatacaaaaattagccgggcgtggtggcgggcacctgtaatcccagttatatgggaggctgaggtaggagaatcacttgaacccagaaggtggagcttgcagtgagcggagatcacgccactgcactccagcctgggtgacagagcaagactccgtctcaaaaaaaaaaaatttcttttttttggccgggtgcagtggctcatgcccataatcccagcactttgggatccacgaggcaggtggatcatttgagtccaggagttcgagaccagcctggccaacaaggcaaaaccctgtctctactgaaaatacaaaaattagccaggcatggtggtgcatgtctgtaatcccagcttcttgggaggctgatgcatgagaattgcttgaacctgggatgcagagattgcagtgagccaaaatcatgccactgcactccagcctgggcgacagagtgagactctatctcagaaaaaaagaaaaagaaaaagaaaaaaaaattaaaatttttcatttattttttatttattttattttttatttttatttttattttatttatggggtcttgctatgttgcccaggctggtctcaaactcctggcctcaagcaatcctcctgccttgacctcccaagtagctggaacaaacaagcacatgccactatgcccagctaatttttgcattttatgtagagacagggtcttgctattttgcccatgctggtctctaattcctggcctcaagcaatcctcctaccttggtctcccaaattgctgggattacaggtgtaagccactgcacccagccctttactgacactcttcagtcctcctctggcccctctcctctctgagcacttcgggaagaccccctttgttggatgcagagagactattggcagaatccacatccccaggcagttttgggctcctctgagagggccttggccagagcagggaagctcagggtcactgtccccactgggaatgccatcctgggactttcccgccactcagccccatggccctgtggtgggagacaaatgggggagacattgtcctgaggcctgctggtgacttgctcggtgaccttgggcaagtcacttcccttctctgggcaagtagaagagggtcctttagttctggcaagtaaaggccaggacagggtggggcagagctgtcagcatagcactcaccgtatttggctgcctttgcagctgccttagcagctgcttctggtgacacaacccctggagagaccaaaagggacacaaatgctcaggagagattggaggagagctgtgtagtatgtatccctctgtctacccatctgtgtgttgggccatctcctttcatgccaacatagagttggctacacatccatttatgcactgatgtccacccacctgcccatctgtatacccagccacccccatcatccatctacctaatgacccacctctatacctgtccatttgtctttttttttttttttgagatggagtctcaatcttgtcacccaggctggagtgcaatagcgcgatctcagctcactgcaatctccgcctccccggttcaagcacttctcctgcctcagcctcccaagtagctaggattacaggcacccaccaccatgcctggctaatttttttctatttttagtggagatgggatttcaccatattggccaggctggtctcgaactcctcacctcaggtgatccgcccaccttggcctcccaaagtgctgagattataggcgtgagccactgctcccggctgtccatttgtctatccttggatatcaatccacccacccaaccacctaactctctgtccactcatctatctgccaacttatcccatctgcctatctatccattcatctaaccatctagccaaccatccattttgcatttgcttgcccaccattccacccacccgtctattcatctgcccctccaaccatgtgctcattcatccacccatctacccattcatccacccgttctttcattcagcctcccatccatccatccctcatccatctacccattcatccattcttccatccatcctcccatccatccatgcccccatccatccactcacctatccatcccacacccatccacccacacatccactcacctacccatctatccacccattcatccatccacttattcatccatccatccatccatccacccacccatccacccatccatccatccacccacccatccacccatccatccatccacccacccatctatccatccattcattcatccacccacccattcatccacttatccatctatccacccacttaccgttttatccaccataaactgaacacctactcagctaagggctaggaacatggagttgaaaaagacacggttcctgccccccagagaacactgatagccagaaggtcaattggaaaatatgatactgattagaagctaataaggagattggtatagcccaaggaagagaagatgaggggatgagacgtggtcaagggtatgggcagatggttatggtgttagggagaatgcaaaaattttggcaatagtctcaatatttctctctaatacacacacacacacacacacacacacacacacacacacacagcccagctcacctggaaccgcagcacctgggatcccagcacctgggacaactggaatcccagctcctgggacaccaacacctggaacgccagctcctgggacaccaactactcccgggccaaagcctggcccaccaggcactaagcctgcagcagctcctgtggaagaaaaagcattgttcccctaacctatgggaacctcagaggggctagaagggtggttagtagagtatggaagtgacagttggtcctgaatgcaggattgcaggtgggttgacatttcctctgcatggatcctactcatcagagagatgtggagagactaagagggtccctaaagagctctaggatttgaatcagtgagctggaggaatgtgatctctttctttttcttttcttttctttccttcctttctctttctttctttctttctctctctctctctctctttctttctttctctctccctccctctctctctctccctccctccctcttttctttttccttccttccttcctttccctttctttctttctctttctctcttttgtttcttcctttctttccttcctgcctctctctctccctccctcccttccttcatttccttccttccctccctccctcccttccttccttccttccttccttccgtctttccttccttccttccttctttccttccttccttccttccttcctgtctctctctttctgtctctctttcctttttttttgaaccaaattctcacttacccaggctggagtgcagtggcatgatcatagctcactgcagccttgaactactaggctcaagcaatcctctcacctcagccttgcaggtggctgggaccacaggcatgtgccaccatgcctagataatttttaaatactttttggaaagatggggtctcagtatgttgctcaggctggtctcaaactcctggttttagcctcccaaattgttgggattacaggcgtgagccactgtgcatagctagaatgtgatctattcctaaagcacagtcagaattctcaccactgggcacccatttagttgatgcagcagacacctgtgggctggccctggaggggatggagtgggaggagccatgtcccctctgcagggtcccctccctctgctgagttaatcagggcaaaacaatagagatggcatctcaggtagagtgatcagaaggggcaaaggtaaggaggcatgaacaatgcatatttgggaaggaacaaaggccaagtccatctggctttgcggctagggtctccgaggtctatgcaggggcccgagccgtggacttgccaccccgggaggcactcaccatacttggctgccttagcggctgctgctgcagctgcagctgcagctggagtcccaacgcctgaaaacacagccacagagggtgaggtccttgccctgtggccatctcaaggacacacccgccccctgctgggacagatgttacctgcgatgcctccaattccaggaattgccccaggcacgccaggaacaccagcccctccaacaccagggaggactccggctgctccagcacctgttgagatggggacagtgcaatgtagtttcccaaggaccctcctgaggacaggcaggatggccacttagacgccggcgttttcaccagtgtgatcttatccaggaatggggcccgggtgtctccagatgggcctgtctggggaggcccccaccccactccactgttccttgactctcccccaaagtgtccatttcaacacactcattaagggacttgtatgttttcagacaaatcccattctaatcactgccacatactgagaaaccacaagtggccgctccctgggccagagggtcccctgcaggaatgttcaagacttcctctccctgtgttccgaagatgcagccaagtttgtaatccaagcgcctggctgcttggctctggcagcccctcacagccctgctctcccgctcccacattgcagccgtccccaccagccgctggggccaaggagcctcgggtgctgggaggggggcctgcggggcctccactgggaggcccagcttcaggcttctccccacattctcgctctctcgggctggtggggagataaggaaagggcttccctggggctgaggatgaaggaggacttcagccctagtggtctgaccctgaggtgggcactacctggggcaggggacagatgcccactccacccactgcacgggcacaggaataccacgttccatctgcagccatgctagccaagaactcactgacctgagcagtgagttaacatttttatagtacacattaaattgatacataactattaaatattttaaatgcttatatatgcaccacctaaaattatctttctaaccaccgtggtacccattccctctgcttggcctcctctttcctgttttaaccacatggtaagctccatctttatttttaaggcctaaatcacatgtcactttctctgggaagcctttctaactttcctcaggtagaaaaaaatgcctcccgtttcttgactcccacaacagtggctatattctctaagagaactcttgtttgtccctgatctctgatatggatgggtgggaggaggcagtgagggagggaaggaaggaggcatggatgaatgcatggaggaaagaatgaatgaatgaatgaatgaatgaatgaatgaatgcatgggtgaatggatggatgggtgcatggatgcatggaggaatggatggatggatggatgaatggatggagggagagatggatggatgaatgaatggacggatgagtggatggatgcatggatgggcagatgagtacatgaatggatggatggatagatggatgcatggaggaatgggaatggatggagggagggatggagaaagtaatagattgatggaaggatgaatggatacatggatgcatggaagaatggttggagggagggatagatagatgggtgatgttgaaaattttgagtaaatgggggtatgtaggggccactttggaggcaggctgtcaatagtaatgggaatggagaggctaggggcctggaggccaccaggtggggactccaggggcactcaccgaactttgctgctgctttagctgccgctgctgctgctgcctgggggccaacccctgggggaaggaagcagaggggagagaccttgaaacagtgctcctgtatctccagagcccacttgttcccagccccaagagagccaatccactgacatgtgggtatacatgggagcttcagagtaggcagaggctgatggagctgccccactcctcccccaggatcctgctccaggtttggaccagggtctggatgcagggtgggctgctgctttcaggagggaacctcacccaccccagggctctggagcctggaagatcagtgctcccttggctggaagtgacgtgaggctttccttacctgtccctgttgggtaaccagccttgcccgctgcaccagccactcctccgggcccatagcctgcaaaacagagaggcttgatggtcatctgtgcagacatcaccactgctgccctccccctccccctgctctgccctcggggcccaagctgtcctgagtctgcacctgtcacccccagccagagtgaaaacaaatacaaacacatgtatggagttgttatgtccattttacagatgagaacacagaggctcaaagaagcaacacagctcacttaaggtctcattattgataggtgggagggcagggatggagacccatgctgagtccaaattccatgccctttccttctgagattcccactccaagaccccaaccctgccccagcgaggtgctctcctggcccagggctggaagcacagcacccttgctaggaccctggagagggaaagagctggaagcccacagtctagaagggtctcactcaccatagggcagtttccctgtggtgtagggcagtccatagccacctggagagaggacagagcaaactcaggggctgccccatgccttgctgggctcccaccaacctgggtggacagatctacccccacaggtgctaaagcttgagacctcccacatcagggtcctgagctgctcccaggagagcaaaggcgctgggtgaaggagggagaggacacctctgcccccgaggcccatggaacacccatccccctacaaattcaagccccatcatggccctggagtctgagtattttccttacaccccctcctcagtggaaagcatcttattgtctaagctgattgcagaggtaggggcgggagcacgagtgggtggatgttagagggatctttccaatgaaccgtgttcctttccaccagcctaatagcttcagatcgggactatgggtctctgtgcatgagcgtgtgtgtgtgagttcaatacctgcagatgactttcccatgctctccttggctggtgaccatacaggggcttcaacaccccttccctgccaccagagacacctgtacccaggctgacttctgtgcagggaggtgcagtgagtggtacattttttttttcttctttttctttttttggaggagagtctcactctgttacccaggctggagtgcagtagcgcgatctcagttcactgcaacctctgccttctgggttcaagagattctcctgcctcagcctccccagtagctgggattataggcctatgccaccacacctggctaatttttgtatctttagtagggacggggttttgccatgttggccaggctagtcttgaactcctgacctcaagtgatctgcccgccttagcctcccaaagtgctgggattacaggtgtgaaccaccacacccggccgagtggtgcatcttgaaccgtccctctgacttaccaggcagcttgggggccttgatgggataccccagtgggactccaggttgcggtcccccaaagggtccaactcctgtgggaataaagagagcaagttcaggtcccagcacccccttccaaaccctccgccacccactccactttctgctcagacagaaggagcttgctacagcatccagaaaccatcctgcttcgagggactccctgaatctccatcatgggtcagttgagaaattcccagtgacaggccacttcctccaggaagctacgggattctctccctcctggggcctgggccccagtttgggcctgcagcccttggcacaggctggagggttttctggactcctttgaattttgggctgctatgccagtggggggagcaggcctgggatgggtgccactttgtgctacagccactgcaagacctggctctgcaggcgtgggagaaattgggcaggcttggatgggatcttgggtgcccaacccctcccaacgccagagcctctgcctggctggccaccctgcttctcccaccagccttgcctcacctgggattccagcaaaagctccacctacacctgtaatgataaaaagctgtcactacagccctggaactgtggacactgggccagacagcaccaaggggccaggaggcccaaggaatggccagttcttcccagaccagtcatcgcatgctgcgctcacatgaactctggggtttcttttttcggagatggagtttcgctcttgtcgcccaggctggggtggaatggggtgatctcaactcaccgcaacctctgcctcccaggttctggcgattctcccgcctcagcctcccaagtagctgggattacaggtgcaggccaccacgcccagctaatttttgtattattagtagagacagggcttcaccgtgttggtcaggctgacctcaggtgatccgcccacctcggcctcccaaagtgctgggattacaggcatgagccactgcatctggccctcttttctttctttcttattttgcgggggaacggggtctctgttgcccaggctggagtgcagtggtgtgatcatagctcacgacaaccttgatctcctgggctcaagagatcctcctgtcttagcctcctgaatagttgggatcataggtgtgtgtgaccatgtccggctaattttttaatcatgtttttgtagagataaggtcttgctatgttgcccaggctggtctttaactcctgggctcaagcgatcctcccagctcaccctcccaaaatactgggattacaggtgtgagccagtgtgcccagccacactctgaggtttttcagcaccaggctgcccagggctggaacataaaaagtgtcacccagagggccctgagccagtccaggatcccaccccatttcacacccggggccagaaggtggttggagagtccctgccatcagccctctgtccagacagctgcatacctggagccttgggcttaactcctgctccagtgggaactccagggagcacccccacaccggggaaccgagctcctgccgggggacaaagcagtgagtgtaggaaggcaggccttgcaggccctgctgggaacccctcccctcctcgggtcccccagctgacctcccttgggactgactgtcagtgacaggcacggctcacggggtgggtggagaaaggacctgtttagtgctgactttccttccctgtctggctcaaggtcagaagatctgagttttaatcctatttcccagccatgtgagctggtgcctcagtcagcctcatctctatgctggagttaatcacaaaagccgtctcgaccaccctccgcagaaaaggtaaagagagggacagctgctgcgcggtgccactcgcccgtagaccagggaggcccatgctctctggggctctcgctcacaacccagacccccaaagcagccatccagctacagctgggaccatgccagcgtcttccacctctcctgtctcccctggggctgggcagccttggctttcagcgtagtgggggagagagggaggaagggccactccatcagcaaatcccacataacagcctaaatctgggcttttgggggaattcaggaggtcacatgttgggtggggtggtcaggccctggcaggggaaaggagggtgaggggcagctctttagggtctcctgcagggcagactcattgggtggccccttggtgactcacagcttttgggaaatagctggtcacactgggatctgtcctcgggggcccgcctcgggctgtgatgatggtctgtgcctgggatcagggcttgggtggggtgcaggaaggctggttgaccttcaggggatggacggactgccagggaccttatgtctgttagcctgagctttggagtttggggaaatggctcaggtcaggacccagggcttctggtggcctctgcttttcggggaggcgaggggggtactagggaggctgagggggctgcttttcttttcctttttctttttctttgttttgagacagggtcttgctctgtcacccaggctgctgtgcagtggcaccatcgtagctcactgcagcctggaccttctgggctcaagcaatcctcccacctcagcctcccgagtagctgggactacaggtgcacaccaccatgcctggctaaatttttttgtagagacgagggccttactatgatgcccaggctggtctcaaactcctggcctcaagccatcctcctgcctcagtctcccaaagcaatgggattataggcatgagccactgcgtcctggctgctttcttcctatagagtccctgtttccctccttgctctcacctgggagcacgccacctgggtatacacctggcagccccacacctgtggccaaaagaaagcaaagttactagcagcagctcagcctccagggacccctccccagcccttcccacccaggcagctccaaggccctcaaacccacagcctctgtgcccgacaggggcagccagggacagacgtggggtggccacaaccctcctcccacgagtttcggaagtcatctgcaaactcttcggtgtgtggatttatctccgtctcctggagcctgtttacatggctgggccagcccacctctggctaacagcttccagatgtccctccctgctgcgtagactcaggcagtcttttgtttaacctgaagtcacttcctaaagggcttggtggggcagaacgagtaccagatggggagtcagaggacacggggctcccccagctctgccgggactcgctgcaggcccttccacactgactcgcctctttgagcctcagtttccccatctgtcgcccgacagcctgccacagagcccgtctctttctaccccaagatcccgggagaagggcccgggaagtgggccaggcccctcctccccatttcacagacgcaggcaccagcctggctagtttctctgcccgactgaagccaggccctgcccttcctccgcaagtgcagtggcatggagagggctctgttcctccctgccctctgcccctccctgccctctgtcctccagccccagggattccgcactgacccggcactttcccaggcttcactccggctccaggctgaggaaccaccgcacctggcacagaaggggctgcatcagagttggctccacccaggcctgcaactttgacccagggagttcggggatagccatcgtacctgcagacactcctaagccaccaactcctgggacaccaccaagcccagcgcctgcagagccaggacaggtgaggcattgcgtaaggaacagtggggaggcagaagggcccggggctgcatgctgagggcccagcattgaggtctggccccgttactaactcaccttcagactgggcacagctagctgcctccctgagccccagtagattgcaactgacaatcccacccacccggctcccaagcctgagttgagggaaggttctttgcaaagcggagggccccacggaagccagagggcttgtggcatgtcccaaagagcaccactcaccagccttagcagctttataggctgcagcagcgtcagccactccaccaggcaccagagcccccggaaaggtaactgcggggaaggcgccgagccctgcggaggggaggatggggtgaggtcctgagctaccacacctatgaagactcctacgctctggccctgcctggctgtgccccactcaggaagcacattggaggctcttccgctctctgccagacatcaatgcctgcaggacatccatgtgagcactgctcaccggtaatggatttttttttttttgacacaaggtctcactctgtcacccaggctggagtgcagtggtgcgatcttggctcactgcagcctcaaccacccaggctcaagcaatcctcccgcctcagccttccaactaggtggaactacaggtgcatgccactgtgcccggcaaattttttttttttttgtattttttgtagtgacaagattttaccatgttgcccaggctggtctcgaactcctgggctcaagccatctgcccgtctcagcctcccaaagtgctaggattacaggcgtgagccaccgcgcctaagtaccagaactagattgtgtgccgaggttaatgtgttagacagctctgacaaaactgcatggctctttttttttttttccctttagagatggggtcttgtggctgggcacggtggcttgagcctgtcatcccagcactttgggaggccgaggtgagtggatcacttgaggccaggagttcgagaccagcctggccaacatggtgaaaccccgtctctactaagaatacaaaaattagccgagcgtggtggtgcacactggtaattccagctatttgggaggctgagacacaagaatcacttgaaccggggaggtggaggttgtggtgagctgagatcaactgcaccaggtgcggggagctgagactgagccactgcactccagcctgggtgacagagtgggactctgtctcaacaacaacaagaacaacaaaagagatgaggtctttctctgtcgcccaggctggagtgcagtgacatgatcatagctctctgaagcctcagcctcctgggctcaagggatcctctcacttcagccttcctgaaaactgcatggatcttttggggtcaaatttccccacccacctcctctagaatgccttcctgaacccctgctgagttaagcgactcccttgggcttccttggtccatggggcttcctccatgcagccttcactactatgttataaaggaacccaggtactcagctgtgatttcctcatgtcctgggcagctgcttggggcagttggtatcagcatcagtccccgtcagtgcccaggacggaacctggcctgcacccttgttccatgaccgtgctgcataccagccctgggttgagctcaggggctggtccccacaggggatatctttcttgggtgtcagcactcacctgccccaaggccagcacccgcaagccctccgggaactgtggataagaaacagagacaggagtgtaggcagtgttcctaggcccagagtgggaaatgtctcctggagttagggcagtgctgtgatcagccactcaggtccctaggctggtccctaagcctgtgatgctcagggtcgatcctgataaaatagcatccaccagtagtttagtgagcgactactatgtgcagtgcaggtgtcattgcaccgatccctaacaagcctgggccaggcctgtgcttctcctagaagccctgctggctaacaagattcagcagggctttcagcaagggctgggacagagcagagtccgtgagcgagacctcaccccaggccagtgaggtctctcttctgcttccttgcagatatctcttgactcagtcccctccccttcacctgcatcggggaactcctgtgtccccactacccatctgtccttccatccagcctgccctgcagcccaggagcctcctactaagatgtttatgagacgccaaatgggtccctctggctctctcctccccacatctgggcccaatcgcttcgtctcccactgcgggagacattccactgccttggccaggaccaatgggccatcaggtcagagttcacaaccatgccaggtttgtttctaattatgtgacgatctctcctacaagtgctagtcctgagcctcaggggtgagtcctctccagggatggatcc

SEQ ID NO: 4531 - DNA, 3197 bp, Homo sapiens
  misc_feature (1)...(3197): n = A,T,C or G
gggttcggggcgtccgcaaccacagcgcgcagggcaggcgcgagctggcctctgagccccggcctcggaccgcccactccactcccggcacgcccggtgccgccttccggctccagtccccgggctcggcctcggcgaggtgtaattcgcagcgcgggccggccccggaggctctcggcgagcgcggcgcggtaacaagtgggcgaggatgccgtacgagatcaagaaggtgttcgccagcctcccgcaggtggagaggggcgtctccaagatcatcggcggcgaccctaaagggcaacaattttctgtacaccaatggaaagtgcgtcatcctaaaggaacatcgacaacccaagcccttgctgacatctacacagagcacgcccatcaggtggtggtggccaagtatgcgcccagcggattctacattgcctccggagatgtgtctgggaagctgaggatctgggataccacgcagaaggagcacctgttgaagtatgagtaccagcctttcgctgggaagatcaaagacattgcttggactgaagacagtaagaggatcgccgtggtcggggaaggaagggagaagtttggagcagtcttcctctgggatagtggctcttctgtgggcgagattacaggacacaacaaagtcatcaacagcgtggacatcaagcagagccggccataccggctggccacgggaagcgatgataacttgcgcggcattctttgagggacccccattcaagttcaagttcacaattggcgaccacagccgctttgtcaactgtgtgcgattctctcctgatgggaacagatttgccacagccagtgctgacggccagatatacatctatgaccgggaagacttgggggagaagggtgttgcgcccctgggcggaagcaaggcccacgacggtgggatttacgcaattagttggagtcccgacaggcacccagtttgctttctgcttcctggggacaaaacttccaagatttggggacgtcagcgtgaactccgtggtcaagcacatttcccatgggctccacggttctggaccagcagctgggctgcctatggcagagaggaccacctgctcagtgtctccctgtccgggtacaatcaactatctggacagaaacaaccccagcaagcccctgcacgtcatcaagggtcacagtaaatcgatccagtgtctgacggtgcataaaaacggcggcaagtcctacatttactctgggagccacgacggacacattaattactgggattcagagacgggggagaacgactccttcgctgggaaaggccacacgaaccaggtgtccaggatgaccgtggatgagtcggggcagctcatcagctgcagcatggacgacaccgtgcggtacaccagccttatgctgcgggactacagcggacaaggagttgtgaaacctggaccgttcagccaaagtgccgtagccgtcggccccgggggatacgccgtggtcgtgtgcattggacagattgtcctgctgaaggatcagaggaagtgcttcagcatccgacaaccccggctacgagcccgaagttgtggcagtgcaccccggcggggacacggtggcaattgggggtgtggacggcaacgtcgccctgtattccatcctgggcaccacgctgaaggatgagggcaagctcctagaggccaagggccccgtgaccgacgtggcctactcccacgacggcgcctttcttcgcggtgtgcgacgccagcaaaggtggtcacagtgttcagcgttgctgacggctactcggagaccaatgttttttatggacaccatgcaaaaattcgtctgcctggcctggtccccagaccaatgaacactttgccttccggtggcatggacatgatggtgtatgttttggacccttgagtgacccggaaaccaggagtcaagatccaagatgcacaccggctgcaccatgtcagcagccttggcctggctggacggagcacacgcttggtcacggacctcccatggatgcctctgtcaaggagtggacaatcaccttactgaggagcccccaccccggcttctggatggaccgaatcaggggactagagtttaactgcagcgggaacatgtcatttctctatttctgtgacgcgcccccatgcccccaccccaccacaagagggcaggagggcccagttcatggaccctcgtcttttgcagggtgtcttgtaacacgttcttcttgaaagcttttaggacagttaacagttttgcacatggaaaattaaaggcgagcacctaaacaatgtgtgggagcattaattaaaacccacagcccaaccaaaccttgagaatgcgaaacattccagagggcagtagcctccaaagcacacgagagccccctggccccgccgcggctcttcactatctgttcagggggaggttgttacaggtgaatgagccgggggggntcatgttcctgccttgcaggaacatttctgttactagtgagaagagggaatatgcatttgcagtttcagcaaagccggaattctgtgttgaacagatgtctgtcttcctagtgtgtgactcacacccttgtggctgccttcagagcgccacctccagatcagatggggacacacaacccctggatatgtttcattgtcagattttgtggcttgattttaagaatggaattgtgggtatctttccttttttttttaatgtatcttaactgttgcctgtcaagtgtttacaaaactagtgccgtngacgcgcaccggtgtcccaagtttttagaaccccttgttagcccagaccggaggtgtcctgggtcaccgtttcacccatcatgcttttgatgttcccccctgtctttcccctctttctgctctcaagagccaaagggttaatttaaggaccaaagatgaagtcactgtaaacctaatcctgtcattgtttttacccttcccttttcctttttcagtgcagaaattaaaagtaagtataaagcacccgtgattgggagtgtttttgcgtgtgtcggaatcactggtaaatgttggctgagaacaatccctccccttgcacttgtgaaaacactttgagcgctttaagagattagcctgagaaataattaaatatcttttctcttcaaaaaaaaaaaaaaaaaaaaaaaaaaaaaaaaaaaa

SEQ ID NO: 4532 - DNA, 1711 bp, Homo sapiens
  misc_feature (1)...(1711): n = A,T,C or G
gggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtaatccacaggccccaggatgcaggccctggtgctactcctctgcattggagccctcctcgggcacagcagctgccagaaccctgccagccccccggaggagggcttccccagaccccgacagcacaggggcgctggtggaggaggacggatcctttcttcaaagtccccgtgaacaagctggcagcgggctgtctcccaaacttcggcctatgacctgttaccgggtgcggatccaagcatgagcccccacggaccaacgtggctccctgtctccctcctnaagtgtggcccaacggccctctcggcccctctcgctggggaagcggagcaagcgaaacaagaatcccatcattcaccggggctctctactattgacttgatcaagcaagccccagacatcccatgggtaccctataaggaagctcccttgacacggtcacttccccccccagaagaacctcaagagtgcctcccgggatcgtcttttgagaagaagcttgcgcattaaaatccagctttgtgggcacctctgggaaaagtcattatggggaccagggcccaggagtccttgacggggcaaccctcgcttgggaccttgcaagagatcaacaactagggtgcagggcgcaggatggaaagggaagcttcgccagggtccacaaagggaatttcccgatgagattcagcattctcctttcttcggtgtggcgcactttcaaggggcagtgggtaacaaagttttgactccagaaagacttccctccgagggatttcttacttgggatgaaggagaggacccgtgagggtccccatgattgtcggaccctaagggctgtttttacgctatgggcttgggtttcagattctcagcttgcaagattggccaagctgcccttgacccggaagcattgagtatcatcttcttcctgccccctgaaagtgacccagaaatttgaccttgataggaggagagcctcaccctccgagttcattcatgaccatagaccgagaaactggaagacccgtgcagggcggtccttcactggtcccccaagctggaagctggagttacggaagggcggaagttcaccaagttccctggcagggaggatggaagcttgcaatcccttgtttgattccacccagacttttaagcaagattcacaaggcaaacccattcaagctggacttcaggtgggaacacgggggctgggcttttgagttggaacgaggattggggcggggaacccaccccccagccccagggcttgcagccttgccccaccttaaccttcccgctggactatcacccttaaccagccttttcatcttcgtactgaggggacacagacacagggggcccttctctttcattgggcaagattctgggaccccagggggccccttaatattcccagtttaatttttccattaccctaggaaggaaaacccgaggggacagcagatttccacaggacacgaagggttgcccctgtaaggttttcaatggcattacaataaaagagcttttatccctaaaaaaaaaaaaaaaaaaaaaaaaaaaaaaa

SEQ ID NO: 4533 - DNA, 2774 bp, Homo sapiens
ttttttttttttttgatctttaaaaaaatcagtttattaatgtttaaaagttgataaagctatgtgcaaaatgatccacaaaagtcagaaacctattaaatactattctttttaaaaaaacaagacatctctcggtttaattgcactgaaaaccatactaaagagacagtaatatatttttattctttgtaatatttatacatatcttcaattactatctaatgaatagctggactgaaaagttctggcgttccctaccagttaaagtaatgcttaagggcacaagagggtggattctagaaaagttaacacgggttagaaaaatccataaaatgacttcttcctgaaacaaatacattcaaaaatcaagaaaagtacttttaacacaacaaaatacaacatgttgttgcttgaaatgaatcacacaagattctgaaataaacatcaacaaaagtgggaaagacggatgtcatatttgttagactcatttgctaagaaatctcccttggtttgcaaaagttaatccattcggttttcactttgttttgcttgtctgtttctcctaggacaccaaggatcctggctaatatcatttagataaagtgggcttccttatgcagatttcggcttcaatggatatgaaatggtaacacatttcattgaaaagatgttttttaaagaaatcaaagtgacttcaaccaaattccaaaaaacggatcccgcttacatggaaactttggcctcagcgaaggacattgttttacacctccaaaccatcttcatcttcccacagcctacgtactcaacatagcctatttgctatagatgatcgatcattccacaaccccagctctgataactctcaggtagttaaagtataaagtaaaagaacgttgaggaggggtatgaagggaagggagggtggggtgtgggatgtacagggcatccctaaagaagcagaagtgcacacactcacttgggtttgaaactaaagtgaaggaaaacatctcctcaaagctccagacaaagagacgctttcacatggggacattagtctttgaggaggggccaaatgaaccctttaggagcttgacaatgctagacctttggctcagtgcaaaatcaaagctccaggggggtagaatatatattccaggccgggacctgatctccacccttcccagtgcattgttcacaggaactaactctacccaccaacacccgacaccaccaggctgttcgtattctcccccttcctccctctggcttgcagcagctcctccctggcagcagtcgaagcccagagatttttttccaaacactggggtggccagcgaccaagtaaagagcgcttccggtgggtggacagcttccagttctaggaagaagagttgacgtttccagaagacataatggtctctgggttgtccccttcgtctttctgggggtgggaggaattgtccgatttgctgcggctgaattccatgccggcgatgatgggtcgcttgaatttgccagcagagtctccgctcgggcacttgcagcaggacatgatccggatgaaggcccgacgcatctccttgttggtcagagtgtaaatgatggggttggtgccggagttgagcacagctaacaccaggaagtactccgctctgaagaggatgtcacaggtcttcaccttgcagcccacatccagcaggagcaggatgaagagcggtgcccagcaggcgatgaagacgctcaggacgataattacggtcttgagcagcgccacattctcagagctgcggctggccttggaaatgttcttgcggaacgtcaggcggcggctccgagtcctgaccaaggagtagattctgcagtacagaatgacgatggagagcagaagcagagtgaagaccgtggtgcagaagaggatatagtgcttgtggtagagcggcagcacggtggagcagctggacagcgcactgatgcagttccagcccatgataggcaggccacccaggatgagggagatgacccagcaggcgctgattagcaggaagaggcggaagttattgctcccgttgtggagtttcattttcagcattgtgatatagcgctcaatggcgatggcgaggagactgaacacggaggctgacagggccacaaacatactcccttcccgcagaaaccactgggcgggagtgagcttgtaggtggtggccccagacaagagcaggttagctgtgtaggctactcctgccaacaggtctgagagggccagattgccaataaaatagtacatgggtcggtggaatttcttggttttccaaatggtcagcaagacaaagatgttctccaggatgataaagcagcagatgagaatgaacaccaccgaggtcagtttaatgctgttctccttgtccgcgctgatattcagctttcccgtgtagttgtaatgccggacgatgatatcatagttgacgtagtcagagaccgagctgcggtgggccttgaccagcgggacgctggtgggccccatggtgccaaccctgtgtccccaggaagccggggtggcgctactccagacgaacgctagagggcgaggcgagagagccttcactggcttcaggggtggttcgatgagtgatccaggctttttgtgtagcttttccttggctggagagggcctcggaaaccgcagcctcgctcaagcagggcgaagttgcgttcggagagcccgggatctgtacggctcgcttcgcatcttgctgctgcccccgacctttaga

SEQ ID NO: 4534 - DNA, 708 bp, Homo sapiens
ttttttttttttttttttttttttttttttttaaaaaaatcagtttattaatgtttaaaagttgataaagctatgtgcaaaatgatccacaaaagtcagaaacctattaaatactattctttttaaaaaaacaagacatctctcggtttaattgcactgaaaaccatactaaagagacagtaatatatttttattctttgtaatatttatacatatcttcaattactatctaatgaatagctggactgaaaagtttctggcgttccctaccagttaaagtaatgcttttaagggcacaagagggtggtattttcttaagaaatacacattcaatggtgttaacacgggttagaaaaatccaataaaatgacttctgctgaaacaaatacattcaaaaatcaagaaaagtacttttaacacaacaaaatacaaccatgttgttgcttgaaatgaatcacacaacattctgaaataaacatcaacaaaagtgccaaagacagatgtcatatttgttagactcatttgctaagaaatctcccttggtttgcaaaaggtaatccaattcggttttcactttgttttgcttgctgtttctcctaggacaccaaggatcctggctaatatcatttagaaaaagggggcttccttatgcagatttcgggttcaatggatatgaaatgtcacacatttcattgaaaagatgttttt

SEQ ID NO: 4535 - DNA, 463 bp, Homo sapiens
tttccttctgaactttataccctcaaggaaataacatacatgaagacacttccatgtttctcttgcatggaccaaacagtagtttggccaaataagtaatgggagcactttctgctatgcttttaacataaaggattcaatgaggatgctgtcaacgtgtaactgtcagataataaatgaatgagttagtgaactttacttaaaacactcaggtttagggtttcaaaaacaaatgtagagaaacaaacaaaagtctgcttatttttttaatgctgacttttgtaatgggaaccaaaaatattaatgtagaccaaaaaagacatttacaggaaaaaggcccaaaattccaaggtagtcaagttactgcatttcattaaatttcaaaattaattggatttttgatgtaaacctccttaacttacaaatgtagattattattaaaaatattatacatgtacatgtg

SEQ ID NO: 4536 - DNA, 538 bp, Homo sapiens
  misc_feature (1)...(538): n = A,T,C or G
ttctaatacttaaatacctagtatgctggttacactagtaaagaggcaatattattctaggagtttaaatgttttatttacttttttatctatatattttttaaaaaacattctcataagctttcatcacatataactctatggtcttcataattttaatttctaatgcctaacagtctatcaacattagaatgtagaaaatcaatccacaaggaagtttgtttttttatctctattgtttcatttttagtatatatattttaggtttttgttcgctcattaaaaaatgtataacaaatcagaagcatataaagtgcattccatgtgtcattgtataatttttaaaaaggctaaaagccatggctctcatctaggtacgtatataaagagttgtctgaggcatgctggctcacatctgtaatcccaacactttgggaggccgagacaggaggattgcttgagcccangagtttgagaccagcctgngcaacatagtgagaccttgtctctactaaaaataaaaagaacttagccacct

SEQ ID NO: 4537 - DNA, 932 bp, Homo sapiens
  misc_feature (1)...(932): n = A,T,C or G
tgctgtcggaaaatgtccagaggcaccatccctgctatgaagagggaatgccagtacaacagccacaaggggtcttcctgtggccctcaaacaaaaaatcactgcattacatcagcagactgcattggagagaaaggcgccgggacagaaaagcctgagataaaccacctgtcattcttggagaaaaggatgctgcggctttcccgatttggttgatgagatggaaaatcaacccttacaggaaggacatcaccaattccggaaaggatgctgcgccagtcatgtttccgcactctgtgagacgttgaaatctccagaagttgcccaaggttttcaagctgaacacaggagaaatgactctggatctctgaggactgttttcctcaataaggagctgcaatcttggctccaccaccctccctccaaaacatctcgtgtgtctggtatctggttatattgtggcctgacagagaagtttctttcggggccagtgaattaaaaaaaaaaaaaaaaagaaaagcgggtcctaccaactcattaatactttaatactttaaatttccctctttatagtaggttgaaatgtcagtatctcttaagaacaatggctgaaccaaatgtttcctcaaaactcacattttttcccaccatttcagaagctgcctcaggactaagctttgattttttttttttttttttttaatctggcccaaattcctatctaaggggcctggggagtcatgcccaacaaaccataaattctcatcagatgagttttatttaaccctatatatggtgacttgctttccagtctgactctgggcatggacatgtgacaaaggaaggaaagtcaaaatattttaccccaaaacatgtttctttggccattattttggaangggtcctggcaaagctgtggnttgtggggggga

SEQ ID NO: 4538 - DNA, 301 bp, Homo sapiens
  misc_feature (1)...(301): n = A,T,C or G
ctgctgtcggaaaatgtccagaggcaccatccctgctatgaagagggaatgccagtacaacagccacaaggggtcttcctgtggccctcaaacaaaaaatcactgcattacatcagcaggccggacgcggtggttcatgcctgtaatcccagcactgtgggaggccgagacgggcggntcacgaggtcagcagatcgagaccatcctggntaacacgactgcattggagagaaaggcgccgggacagaaaagcctgagataaaccacctgtcattcttggagaaaaggatgctgcggcttt

SEQ ID NO: 4539 - DNA, 302 bp, Homo sapiens
  misc_feature (1)...(302): n = A,T,C or G
tatcttattagggagttgtatgtcagtgccatggcttcatggcattcagtgattagtggtaatggtaaacactggtgtgttttgaagttgaatctgcgccaaccntatgtgttttctgcagttatttctcttnttctggccaaacaaccctaaaaatccttaccattccacaaagttgggaccatcacttgtggcacccactttgactatgagtataccaccacattggcatttctgtttggcaccaggtcttccggggggactaggactantgttgtccgggggtcaattntgaggngtaa

SEQ ID NO: 4540 - DNA, 439 bp, Homo sapiens
gctggagcggcagcggcggccgggcacggcgcgaggtgacgccgccgccgccgccgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggcttgc

SEQ ID NO: 4541 - DNA, 532 bp, Homo sapiens
ccccattacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagcggcgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacct

SEQ ID NO: 4542 - DNA, 375 bp, Homo sapiens
ccaggttgctgtgttgcagtgcattgtgttgcaggattgggaagggcacctgtgctggttgcacttgctttgattgaatgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttt

SEQ ID NO: 4543 - DNA, 4204 bp, Homo sapiens
  misc_feature (1)...(4204): n = A,T,C or G
ggcacgagcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccgggtgtcgcgcgccgaggctgggggggagtcgtcgccgccgccgccaccgctaccgccgccgggtgtcgcgcgccgaggtgactgaggagagaggcgcctcctcgctcccgccaccgccggacttcaatgcccagtccccagctcgccagcgtttttcgttggaatatacgttgcacatttatggcgattctgagtgtgagggcagacttctgccaggctcagcacagcattttcgctgacaagtgaagtttggaggttctatgtgccataattaacattgccttgaagactcctggacaccgagactggcctcagaaataagttggctttttttttttttaattgcaagcatatttctttttaatgactcccagtaaaaattaagcatcaaggtaaaacaagtggaaaagtgacctacaatttttaaacttgtctcactagtgcctaaaatgtagtaaaaggctgctttaagttttgtattgtaagttggatttttttggagtccgaaggtattccatctgcaggaaattgagggcccaaattggaatttgggatttcaagtgggattcctaaatactttggcttatccttgaaggagaggaagcttcattaggggattaaacaagttgaatagagaagaacactgattgattaatatgcattttagtggtcctttttaatggttttcctgctgtgaaacatttcaaggatttattgattttttttttttcacttttcactttccccatcacacttcacacggcacggctncacacttttttatttggccaaaaatggaaccgtcccagccccctgtgggagatctcctatgaggaacatgcgttttctgataactcacaaccctaccaatggctaactctcaacaagtttcacagagggaacttaaggaagtatgggagtgacggactttgggttcggagtttgtggatggctacatatggataaaggctccagtttggaaaaaggagggattccacgttctaggattgggccatttggatgatgggagctccacccccttaattcagatagtaggatggattgggtttaaacctgtttaaaaaaccaaattttcgtgtaagagccaggtttgctgtgttgccagtgccattgtgttgccaggattggggaaggggcaccctgtgctgggttggcaccttgcctttgatttgaaatgtggaaatgaagtacgaaagatgccagttcagtttataactacaaaaaagaaggggagccgttcaattcccaaacagcctgcctttatttggagaaataccgaccctaagatgcggattacgcttcagagatacccaatgggcattgcctgtgttcagtagaaggaaatgtaaacgaaggctggacttggattgtgccgatttagagggaactcttggtaccctggaaatgtgaatctggaatattacctgtgtacatcaaagtagtgatgggattcagttactccttcaaccactctcctaatgattgggaaccaaaagcaaacaaaaaaagaaacctcctcctataaaaatgaaataaaatgtttaaggaaaaagagaaggagaaaaggaatttaattcagtgcaaggatgattttgcctccctagttttggaagtttgaaatttctgcccaggattgaattattttgaaatctccttgtcttttttaaacttttttcaaaataggtctctaaaggaaaaccagcagaacattagcctgtggcaaaaccatctggtttggggagcacactcttccaattatgcttgggcacatagatctccctgtggtggggatttttttttttccctttttttgtgggggagggttggtggtatatttttcccctctttttttccttcctctcctacatctcccttttcccccgatccaagttgtaggatgggaatagaagcccttgttgctgtagatgttgcgtgcagtctggcagccttaagcccacctgggcacttttagataaaaaaaaaaaaaaaacaaaaaacaacaccaaaaaaacagcagtgatatatatatatatatatatatatatatatatatatatatatatatatatatatataatatatatatatatatatatatttcccaggtggtttttagtcttttactgatgaaaagggtgttcatggttagtttcttcaaaaccctattcttantacttaggccaaagtagccaagagccttttgttttgtttttattttgataaaatttagtggagaaatggcattttaaagagggagtctcttctccaacttacctggagagtcggaattcttctcttcccctaacccaatgaagctaagtgggttatccccaggaaacttgtcttctaaaagggagggactcccaggcccatccaataaaagatgtcccaggcaagtgaacggtacttttttacaccctgtagaattgtggggctgtagcgttactctgattttctgtcctagtatcagagaatgctggtagcttaaaatttttattttaggacttgtactctgaattttcaggaaccgtcaaaggagcagcagcaaattcacatattttcgacttggagaaatgcttgtgggtatgtgttttccaaactggccccctatatgtaaagttccagtttaaccgactgagttgccttgttattactaggtttgttgagattaaaaaaaaaaaatccctgggtttaaaaccaacaatggatgcctagtgagtatgtgtccacaggccataacagggtagaagagagacatcgtgcaacccaatgagtagtgaagggacttgtgttgcttgttgaagccgtgtagtagcatttttgcagattcttggctggggtttagtgtactgatctaggaaaagctgtttttctgctcctttgtgggaaggcagttatgatccaggctgcatgggacaaagcaggtaggagggggcaccctcagggggctctttgcactattttcaccctctaaatattacggtacttcagtagtgcccctgcttctaggggctctggaatacggggcttaaagtcatcttgtcctgctgggaatttgctgtgcagaggccattaagcctcccattttgttagcgtcagtacggccaataggaacagaccgggaccttgtctcacactgatgatacctcacatgttgaccggctatgtgaactgcctatttcctattgctggagttgtgtgatttttaactgagacgcaaaatctgtagattcctctcctctcccatcccagaaaacaaaacaaaataatggttttcggaaattgtttcttagggattttaaaacataaatggtatatcccaaaattctttatttcaggaatggcaacaataggattccattaaatataggactcaaggatcaaaacagcataccctgctaaggttaagatagatggtgttgattcccactggggttttgatcaataccaataacaaaacctttttccttttgacatactctggaattttgttgtttggggggagggggtgtgtgtgtgtgtgtgtgtgtgtgtgtgtgtatgtgtgtgtgtgtgtgtgtgccacgccgccagtgtcccatcaagtatcaagtgccctgccctgagttagggaaaattacattccctggttcctgtattgagggagaagggtgtattaaaggcaacatgaaaacatttagccctccttttattttaaagacctaatgttaattgttcttaaaactgggatttttttttccttaaagcgaatttttttcttttcgatttaatgaagtattgcctagctgaagccagtttgactatagagagctggtcagattgatttgaaaggtgtgcagcctgatttaaaaccaaaccctgaaccctatttaaagaacaaaaataacatattttacacgctcaaaaaaaaaaaaaaaaaaaaaaaaaaaaaaaaaaaaaaaaaaaaaaaaaaaaaaaaaaaaaaaaaaa

SEQ ID NO: 4544 - DNA, 2289 bp, Homo sapiens
  misc_feature (1)...(2289): n = A,T,C or G
ctgccaggcaattcggcacgagcctttccgtctggcggcagccatcgagngtaagccaagatgggtgcatacaagtacatccaggaggctaatgcagaaagaagcagtctgatgtccatgcgctttcttctgagggtcccgctgcctggcagtaccgcagggctgctctggctctcccacaggggctccccggcccccagccggccctgaaaaaagcgcgccgcgactgggggttacaaggcccaagccaaggtttacgttataataataggattccgtgtttcccccgtggttggcccgaaaaacgccccaagtccctaaggggtgcaaactttacggccaagccttgtccatccatgggtgtttaacccagctaaaggtttgcttcggaagccttccagtccgttggcagagggagccgaagctggaacgcccactgtgggggctcctgaagagtccctgaatttctttactggggtttggtgaagatttccacattacaaatttttttgaaggttatccctcatttgatcccattcccataaaagctattcagaaggaaatccctgaccaccccagtgggatcacccaaacccagtccacacaaccacgagggagatgccgtggggcttgacatcttgcaggcccgaaaagaagcccgtggcccttggaaaaagggcccacaaagtttcccaccacattattgcgtgggctctccgccggggcaagcttggagaaggccgcaatacctctccaagctcccaccgttaaccgctaaatattaagtaaaagtttgtaaaaattcattactttaataaacaaatttagggacagtccatgtctgctttacaggtgttatttgtctcttgttaaaaactagtcttgcagatgtttctttgaatgctttgtcaaatttaaggaaagtttaaagtgcaattaatgttttgaaggacaattaagtgggtgggtgttattcttgtttcttaattaaggtaaactttttttgtctttgctttatcttattaggggagttgtatgtcagtgtataaaaccatactgttgtgggtattaacagggcttaattaaattctttaaaaggagagaactgaaactagccctgtagatttgtctggtgcatgtgaatgaaacctgcagctttatccggagtgatgggcnatgctctgctgggtttattttcaagtgggctgcgtttttttttaggtttggcaggtgtaggactttttaagttggggctttaggaaaatctggggttagccctgaaggaaattgcctcagccctcccacagtacccattttaaaattccacattaaaagggtggaaagctccccggggtcagtgccatgggctncatgggcattccagtggattagtgggtaatgggtaaacactgggtgtgtttttgaagttggatgtgcgataaaattattagcctttaagattcggtaagcctagccaatggaatgcttaggggtgggaagctgggtggagcccagtggcccattagataaatacctttcaagtgtgagcttagacggtcaacccttaaaatactttaaccgttaatgcttaattgtggatccattatggaatcccttccagtccacatttagggggggaaagtaggtttggctataagtaccgtcattccttaagtccagtcaagtccttaaaaaccatcttggggtaacccacttctggtccacttcccataaggctacagaaaaagtcacaagccgcatgggtttcccaccccataatggtggttttcctggaagttaatttctcctgttcctgggccaaacaacccctaaaaaatcccttacccattccacaaaagttggacccatccacttgtggcacccacttttgactaatgagtatacccaccgacnattgcaatttctgtttgcacccatgtccttccagggagactagactactgttggtccaggggtcaatttgaggtgtaaagagaaatgtgtggccaaggaattggcccaatttttaaattctgactttgctgacttaatttaaaatgctcggttctgaacccaattttctcctatcttctcgtaggggtttcaaaaagactcgagttaattgatttccagggaagtactcatagcaagttcataaaaggttcttgaggacctaaatttccttcaccaaaaaaagaaaagatcttaaggtcatacatttttaattgtgtaggagggtgtttcaactggagggattaaatgtctattaaactaaaaaaaaaaaaaagg

SEQ ID NO: 4545 - DNA, 776 bp, Homo sapiens
tttttttttttttttttttttgagacagagtcttgctctgtcgcccaggctggagtgcagtggcgcgatctctgctcactgcaagctccacctaccgggttcacgccattctcttgcctcagccttccgagtagctgggactacaggcacctgccaccacgcctggctaactttttgtatttttagtagagacagggtttcaccatgttagccaggatgatctcaatctcctgacctcgtgatctgcccgcctcagcctcccaaggtgctgggattacaggcgtgagtcactgcgcctagcccatgtttgttttttataaaagcatgcccttacatgagaatgaaagtaatcctttcatggtgtacaggaccccagctttagggtcttttgataactattttggctattaagccttttcccccttttagtgcctagaaaaagtagaggttgtatggataagtgccccttaatagccaagacttcttgaggactaaacctcaatttccttttataaaatgatgatggcaatagtccctacctcagtggtctgttgtgaggattcagtaaaataataaagtgcttatcatgctgcctggtatatatgaagtgttgatgttaactgttactattagttgtatgtcacaatagtaataataagctatctttcacataagaaaatattgctcttgatccatcaccaaagtgtgtgtactctgaactgtatcatcaggagaggttaaaggatttgctcagaacaaataaaaaacctctccct

SEQ ID NO: 4546 - DNA, 299 bp, Homo sapiens
cgctggtatatatgaagtgttgatgttaactgttactactagttgtatgtcacaatagtaataataagctatctttcacataagaaaatattgctcttaacctcacttcacatgtgttcgtgtccttgacttccttggcatgacgcagtgaacccttgggtataaccccagatgaacggacactgtcttcatttccttgggcatgaggcaatgaacccttgggtcttaccccagatgaaccgacacctgccttcatttttggggcccccaggggggtatcaagggtattcatcatccag

SEQ ID NO: 4547 - DNA, 410 bp, Homo sapiens
ctactactactaaattcgctgccgcgtcgacttttttttttttttttttagagatgcagtcttgctatgttgcccaggctggtcttgaactcctgggcttaagcgatcctctcacctcagcctccgaaagtgctgggactagaggcatgagccaccgcccctggcctaaacatcatctttgattctctgtttctttcatgctctcctgtttgctctgcctccaaaatctatccttagtccatcactttttccccctctgccccttcgtctcttctccaccaggcagacaactgagccttttaaacctccatcagatttgtcctctcctggcttggacccctgcaatgacttcttacctgggtccagcctccgtcgacgcggccgcgaatttagtagtagtaggcgacagc

SEQ ID NO: 4548 - DNA, 331 bp, Homo sapiens
atgatcgctcgacatcgatacgacttttttttttttttttttttttttttttttcggtagagataggtcttgctatgttgcccaggctggtcctgaactggcctcaagcaatcctcccgcttcggcctcctgaagtgctgggattacaggccaccggcctgggctgactacacaacctttagggcacttcaccattttccataataccccaggggatctcgccctatgaaggcaagggcctccctgtatatcttgagtctgcatttctctctgaattcccaggttgttgtatttttctccctgcctgccccttctgtcgtcttctcgcagc

SEQ ID NO: 4549 - DNA, 782 bp, Homo sapiens
  misc_feature (1)...(782): n = A,T,C or G
tttttttttttttttttcttttttgagaaggagtttcactctcgttgcccaggctggagtgcgttggcgtggtcttggctcactgcaacctctgcctccttggttcaagcaattctcctgcctcagcctctcgagtagctgggattataggcgtccgccaccatgcctggctaatttttttgggtgtttttagtatagacacggtttcaccatgttggccgggctggtctcgaatgcctggcctcgggtgatccacctgccttggcctcccaaggtgctgggattacaggcatgaaccaccacgcctggcctaaaatgtttttaaataactgtacttgtactcactcaccctacctccagggcatagtcagtctgggctgagatccccatgatcagatatttgatggaaagtcctgaaaggccaatgagttggatggcaagaatgcaggcagaagctgctggataaaataggctacagccacctcagatgctttcagtgctctgtctgaggatgtgtatatgcatatgcaaactcgacccccgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccagggggtttgggaccaggcctgggcaacacagggagacccctctctaccaaaaccntttttaaaaattaacctgggtttttgtt

SEQ ID NO: 4550 - DNA, 541 bp, Homo sapiens
cgttcctgcccagataatggctcaataactctgaggctggttgctcagcctctgagggcaatacaggcatttaaaaaattaaaatgaccaggcacagtggctcacgcctgtaatctcggcactttgggagactgaggtgggagcatcacttgagaccaggagtttgggaccaggctgggcaacacagggagaccccctctctacaaaaacatttttaaaaaattagctgggcgtggtgatgcgtgcctgtggtcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtgaaaaaaaaaaaaaaataataaata

SEQ ID NO: 4551 - DNA, 3479 bp, Homo sapiens
agtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcatggcggccaggaacacgctctcttcctctatacgcaccggaggatggccattaccggggacgatgtctctctggaccagatagtgccagtctcgcgggattttacgctggaagaagtgtccccagatggtgaactctacatccttggctcagatgtgaccgtccagctggacacagcagagcttagcctcgtattccaactgccctttggttcacaaaccaggatgttcctccacgaagttgccagggcctgtccaggcttcgattctgcgacccgggatcctgaattcctgtggctgtctcggtataggtgcgcagagctggagctggagatgccaacgccgcgcggttgtaactcggccctagttacctggccagggtacgcgacaattggcggaggtggttctaactttgatggtttgagaccaaatgggaagggagtgcctatggaccaaagctccaggggtcaagataaaccagaaagcttgcaaccaagacagaataaatccaagtccgaaattactgacatggttcgctcctccactatcacagtgtcggacaaggctcatattttatccatgcagaagtttggactgcgagatacaattgtgaaatcacatctactacagaaagaagaggattacacctatatccagaacttcaggttttttgcgggaacatacaatgtaaatgggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgatgtgatcttgtggctgggggacctcaactacaggatagaagagctggatgtggaaaaagtgaaaaagctcatcgaagagaaggattttcaaatgctgtatgcatatgatcagctgaaaattcaggtggccgcaaagactgtctttgaaggcttcacagagggtgagctcacattccagcctacttacaagtatgatacgggctctgacgactgggataccagtgagaagtgccgtgctcctgcctggtgtgatcggattctctggaaagggaagaacatcactcagctgagttaccagagccacatggccctgaagaccagtgaccacaagcctgtcagctcagtgtttgacatcggggtgagggtcgtaaatgacgagctttaccggaagacactggaggaaattgttcgctccctggataagatggaaaatgccaacattccttctgtgtccctgtccaagcgagagttctgttttcagaatgtgaagtacatgcaattgaaagtagaatcctttacaattcataatggacaagtaccctgtcattttgaattcatcaacaagcctgatgaagagtcttactgtaagcagtggctgaatgccaaccccagcagaggcttcctcctgccagattctgatgttgagattgacttggagctcttcgtaaataagacgacagctacaaagctcaactcgggtgaagacaaaattgaggacattctggttctgcacttggacaggggaaaggattactttttgtctgtgtctgggaactacctgcccagctgttttgggtctcccattcatacactgtgttacatgagagagccaatcttggacctaccacttgaaaccattagtgagctgactctgatgccagtatggactggagatgatgggagccagttggatagccccatggaaatccccaaagagctctggatgatggttgattacctgtaccgaaatgctgtccagcaggaagatctgtttcagcaaccaggcctgaggtcagaatttgaacatatcagggactgcttggatactggaatgattgataacctctctgccagcaatcattctgtagccgaagccctgctgcttttcctggagagccttccagagcctgtcatctgttacagcacctaccataactgcttggagtgttctggcaactacacagcaagcaaacaggtcatttctactctccccatattccacaaaaatgtcttccactacttgatggcgtttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacctgtttcagctcaagagatgccttaagataattatgtgaggccacttggtagcaagaatggcagctatttcctgagcctagtaccccaattaagcccaccattggttagcacactcagcgctgtgagtcgtgaagacacgggagaaaatccaccataataaaactgacattcaattttcaaaaaaaaaaaaaaaaaacagatttttttattttttatttttttttattttgagacggggttttctctgtcgcgcagggtggagtgcggtggcacgatctcggctcactgcagcctctgcctcctgggtgcaagcaattatcctgcctcacctcccagttacttgggaggctgacgtgggtggctcacttgagcacaggagtttgaggctgcagtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtgaaaa

SEQ ID NO: 4552 - DNA, 489 bp, Homo sapiens
ttttgcgagaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagccccacgtttcagctcaagagatgccttaagataattatgtgaggccacttggtagcaagaatggcagctatttcctgagcctagtaccccaattaagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatatcctaatgataaatgtatttttaacagtga

SEQ ID NO: 4553 - DNA, 787 bp, Homo sapiens
gtcttctggcttttcagctgttctttgtagtcccttttattatgcataaaataaagaaattcttagattaaatcagaatgctgaataaccttgtagctagcaataaggtgacttacaattgtataaacaggaagccaggcttttgaactgtttacttaagattctgtggtgtgacatctctgttattgtttccagtcaatatttacaaagcatcctaaagacagggtcttggaaattgtcttcagatgatcttagaggtctctgccaagtctgagagtataattctgtaggtattgtgttatttgcaacgtgaaatagtgcattttcttaatcaaatgattgtaaattatatttacttgtaatcagttccatagctttagacggtggttagattttttttttccccaccagggtcttgtttaaaggggtgagccaccgcacccagtcctgaggggtggcctctgctgctggatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttttcatattggaaaagtaattcatattcagtagaggaaaactgaccaaaacagaagc

SEQ ID NO: 4554 - DNA, 430 bp, Homo sapiens
gaactgctgaaaaattcagcaaaaaatcatttggatgagaatattctagctagcatatttggcagcttattgcttcgaaacccagctggtcaccaaaagcttgatatgacagagaagaagaaggctcaagaatttattcaccagttcctctgcaacccactctgagcctatctctcctcctattttacttgaggctgccaattaccagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaactttttgtttaacaaggtaactttttgtttaacctagattttttttaaaactttttttttttt

SEQ ID NO: 4555 - DNA, 330 bp, Homo sapiens
ctgcctgcctcggcctccccaagtgctggattacaggtgtgagccaccacgcccggcctttttttttttttttttcttttttgagatggagtttcactcttgttgcccaggctggagtgcgttggcgtgacctatgaccacatcactgtacgccagcccgggtgagagagggagaccccgtctctaaaaataaaatgtaaaatcactgaaaaaatgagtgttcggtgaaacaagtgggattttctgggccagcaagtcttccaaactgtatatgatgcatcctgtctccatgtgtaatatattttaatgataaatgtatttttaacagtg

SEQ ID NO: 4556 - DNA, 990 bp, Homo sapiens
gatgaggagcttgaggaagcaggcagggaaatgtctgccgccgccagctctcgggagcgcaacactgcaggtggttctaactttgatggtttgagaccaaatgggaagggagtgcctatggaccaaagctccaggggtcaagataaaccagaaagcttgcaaccaagacagaataaatccaagtccgaaattacctgacatggttccgctcctccacctatcacagtgtcggacaaggctcatattttatccatgcagaagtttggactgcgagatacaattgtgaaatcacatctactacagaaagaagaggattacaccttatatccggaacttcaggttttttccgggaacattcaatgtaaatggggcagtcccccaaagaatgcctccggctgtggctgagcaatggtatccaggccccagatgtctattgtgtagggttccaggagcttgatctgagtaaggaagcttttttctttcacgataccccaaaggaggaagagtggttcaaagctgtgtcagagggtcttcatccagatgccaaatatgcaaaggtgaagcttatccgactggttgggattatgctgctgttatatgtcaaacaggagcatgcagcttatatctcagaagtggaagccgagactgtggggacaggaatcatggggaggatgggcaacaagggaggcgtggcgatcaggttccagttccacaacaccagcatctgcgttgtgaattctcacttggcagcccacattgaagagtatgagaggaggaaccaggactataaggacatttgttctcgaatgcagttttgtcagcctgacccaagccttccccctctcaccatcagcaaccatgagtgagtctggcttccaccccatgcggttcaccatgagtacatagagttgtgggctctgtcttttcatggggagatgcctggtggtggtttcctattgctgcaatggtggtagctcccacctcttggtt

SEQ ID NO: 4557 - DNA, 568 bp, Homo sapiens
  misc_feature (1)...(568): n = A,T,C or G
tttttttttttttttagagacagggtcttgctatgttgcccaggctggtctcaagccgtttatcagcacagccaattacaattaaacatctggttgggtttttgtctatcgtcaccttggtccctaaacgtggatcagctaaaagcctaatgtgtcagtaattctcttcttctcagagttttagggccgtttctccctgaaaatcactcttccagttgaataatgtcatagtcacggatatagattctatgtccgtaacttttcaaccacaggacttctggggggaaggagaaaaaaggaaaaacataatacttcacactcaaaatgacctaattcacaaaagtaaaaagaaaagaaaatgtttcagctccaaaagctttatggagtgtctgaagctgaggtgtgcgtggggtggaaacgtgctcggggaatctgagctgtaactatgaatgncccaattcccaggcctggccaacacggggctgcaaatctaacagggaaaacgggaggggaagaaggggctttgaagctgctctttactccntcctttcacatnncctcctgggag

SEQ ID NO: 4558 - DNA, 878 bp, Homo sapiens
  misc_feature (1)...(878): n = A,T,C or G
caagtacagatggggtttcaccgtgttagccaggatggtctcaatctcctgaccncgtgatctgcccgtctcggcctcccaaagtgctgggattataggcgtaagccaccgcgcccggccaaggttttattttttaattagcctatggnacttactttattttctaattttttttccaatcataacagtaaatgaagaacctttgtttaaaaaaattacctgatgattccaattattgttcatgtacaactttatttaaaatggcaatctgagttgtcttcctgacatactctgtaccaaatcttagtactcagtttcatcaagtcctttgccaattcatatattcaaaagaaacatgataaaatgtaaaaggagaatggagtgcgttaaggaataatcaataatttaagattatcaataattttgatattaatattaatttcttagctgtcctactttaatgattttcattgaaactctggcacatctttaatagtctcatgacattactatttaaataaacatgattttcatccaaattattttattcttcttttttgtttttcctttggagacagggtctcgttctgtcgcccaggctggagtgcagtggtgcgatcttggctctctggaacctccgcctcccaggttcaagcgatcctcccgcctcacccttccaattagctgggactacagatgcccaccaccagccccagctaacttttgtatttttagtagagacagggtttcaccaagctggtctcaaactcttgacctctggtgatccgcccacctcggcctcccaaagtgctgggattacaggtgtgagccactgtgcctggcctattttattcttatttataacggttttctcaatt

SEQ ID NO: 4559 - DNA, 4260 bp, Homo sapiens
tttttttttttttttcttttttttttttttttttttttttctgcagacatcagtagtttattgtttgtttagtccaaacacattcaatatggaaactcaaagaatactttccacctgaaacaattaaactagattctactagcatataatgcttaacacattacagcaataaagatggtaatccattgtcttctatacctactaaagccaagatggtaaagccaatttggttgcaatagtgtcataaggatagaatattaccatcaaaaaataaaacaaaatcagcaaataacagtaatggtagatgaatatttttactctgtttcactgaaaagaggacaaaatgttaaaactccacagtactgcaggtgaacaatcaccatgtaaacttctccatatgatgttttaatgttttattcatggtatgtaaagactgaagctgaatggctctttgctctacttttctattattacacttaacatttgtcattacttttggtgccagaacagttttcatggatggcagggcaatatcctgaattggaaattatatatatatatatatatggaaacagaaatacaagaaaatatgcttgggggaaaaaaaacattgacaataaaacaactgcttctttaaaagtagtattaataaaggcttcaaaactccaaagtaattttctggtaagaatttcaagtactatatcagaaagtataaaactgtttcaaacagaaaaaaaaaaaatccttaagccccccaaaaatggaaactatgaaaatctgtgtccccaaaatatatgcaatagtgcaagactttccctcaaacatggaagacctcattcaaagggggaaaaagggacagattttactcatattgcccagtacatgaaaaacaaaatacatgcatcatttgctagtttactaaatagcaaacagttgcataattcagaacccaatttgctactatgtcaagtgcatatcttgtctgttttacaaagatagaatggagaagtcttccatgctaacgagcagctttaagtggtcacacttatttaccccactcctgcctgaaacatcagaaactggtatgtactgactgctccaagcataaaattggataagctttgccatacttgtggtttactggaacttgctataaagacagacaataatccagcagctacaaactttgctcacagaattgtttaaagattcatgtaaaaataaaagatgtcgtcccagacttaaattcaggagccactcgggtgctgacatcagttcaagaattgtgcaaaatgaatgacagttccctgccccccaaatagaaaatgcaaacacttaaagagctgctgttcttttctccgaaaattgcagtatcctcacttcaggcttacttgccatttatagaatctgactgcttttaaaatgtcactaaaaatgtacgtcaagttgactgacttttccaagccctgaagtgatatgtttcaacgtccacattcaggctaagagaaaagtcaactagaggcttactcaaataactgacttcctccttccctctccccacaaacacacaggactccctccctcccacagagaacacaaagttgttaactgaagaacaagataaataatatgctagtccattttactgattttaaagatactgcaatttttatacatttcgatgatttttcaacattttgcagctgtttggctttgcagcacagcaattcatacactatactgtacaaaattaccagcaagactggaatgatgtattaatagaaggcaccatcatgcttattacattaccagagaacaaaaatacagtaaagacaattttcactgtacacagcttaaagaaaggaaaaaaggggaggaggagtgtgttgagcagccagccatccctgtactgaagaggggcaggtagaaaaatcttagatatggagctactaaatctggtctaatagtcaagaccatcgcatttgaagttctaatttttattatttagttcataactaaaatgatttccttctggaatatacttgtagtcttgttaaggtttatgtgtacacacgctggtcacagcaagcagataaaatgccctcatcatttcacaaactattttctactggaaaagaagatgagattttttccctgttgcctcctgttgcagatgtcaatgttaatgagttcagagtacccattagtacattttgatgagtgcataacaagtttctgttggtttgtatttttggggggagccaagaaaaaaggcaagattctccaattgcacaaattgcactatttgtgttcccagcattaacaggcagaaacagtaacacttaaacaaaatgtgcagcagaagattttttttttactcaaaggacctgaattcagtgggcatgtccttttaagttcactttgtcgtagatagtttaagatatggtcatttctcagtccttaattctccaagtctagatttataaattaacaatgtgaatcctgttgtgaaattggggaaataatgtccacctcaatttaactgataaccaaagatgcttttcacatcaaagaaatgatcaaaaaggctgtgtcacattccaaagccaaaaaaaaaattaacaagaatgcaaacacgatgaataatgtaccactgccaagactttgccaacagtggagcttcagcgacgctgtcctgtgaagcggccctccatttgcccggttcctcttccagagccaagtttctgtgccatgccaccccttggaggaggtcctcttccatcacgatcacgcatcattccaccacccacaattccacgtggaccaccgggacctcgatcattgcgcctaatatccctgcgatcatcaccaccacctctggtttctcgctctcttgcagctcttgtttttttctcttccacatttaaacgtacttcccctcgaaacataatcggttttgcaattaagattctctgaactggttcagagtcatcaaaaaccacaaaaccaaaatttggaagctttcccccaacacccttggtattgatgcgaagttccacaacgtttccaaaactcatgaagaattcctttagctcattttcatcaatatcatgtggcaagttaccaacaaaaagttgatgactatctggatagcgaattattctacggttgtcagagtcattctgttccatatctcctctgcctggtcttggtcctctaggaggaaaaccaggtcgttctctaggtcgttgttcacgcacacgaggtggctgagattgaacttctggtttagcttcgactcttggctgtgagactggtgctttaacatggggtggaattccagaggaagaaacagtaccactaggaggcaggtttttactggtcactgaagcccaggagaaagcctttggtggttcttgtggcagagaaacaggttctgccggaggaggagtagtagatttctcctctagttcttctaagttcttctcctccacttgtggtttcagctcttcagtctttgtttcagattctggctcaggttcaggttcatgagaggattcttccaaaggctcctctatgccattagtcacagggtgagcttcatagtaaccactgttagcattttcttgcacaggttcaggagatggttgtctttcttcttgttcctcttctacttcatcttctgattcttcatcaagttcaggctcagaatcaccaaacacttcatcttcataacgaaacatatcattgtgaacataaaatttatttggaacagatccttcaggagccagaacaaaggtttgcataaactttctttctggttgtccactgttagacagcaaacccatgacctggacaactactccatcactcaaggttgcatgagcatccacatgacgaattttagtatgacattcactgaagttcagagataatactttgtggtgtatatcattttggccataaacagcttcctggggctttccactagcatctactccaccatgaacataggaagaattcctgccataaaacctgtgtaaatattccggagctttattcagcaaagtataatattgcctcacaaactcccgccctacaagcagcggactgggcttctccataaccatttctttgctgcacaatgtcaaatgctagaggaaagactggtcttctctcacgcacacacggcaccgtagggagccggcaagaacaatgtctctgccgctacacctccggctcccgggctcacagcagcgg

SEQ ID NO: 4560 - DNA, 1932 bp, Homo sapiens
  misc_feature (1)...(1932): n = A,T,C or G
tcagtgggcatgtccttttaagttcactttgtcgtagatagtttaagatatggtcatttctcagtccttaattctccangtctagatttataaattaacaatgtgaatcctgttgtgaaattggggaaataatgtccacctcaatttaactgataaccaaagatgcttttcacatcaaagaaatgatcaaaaaggctgtgtcacattccaaagccaaaaaaaaaattaacaagaatgcaaacacgatgaataatgtaccactgccaagactttgccaacagtggagcttcagcgacgctgtcctgtgaagcggccctccatttgcccggttcctcttccagagccaagtttctgtgccatgccaccccttggaggaggtcctcttccatcacgatcacgcatcattccaccacccacaattccacgtggaccaccgggacctcgatcattgcgcctaatatccctgcgatcatcaccaccacctctggtttctcgctctcttgcagctcttgtttttttctcttccacatttaaacgtacttcccctcgaaacataatcggttttgcaattaagattctctgaactggttcagagtcatcaaaaaccacaaaaccaaaatttggaagctttcccccaacacccttggtattgatgcgaagttccacaacgtttccaaaactcatgaagaattcctttagctcattttcatcaatatcatgtggcaagttaccaacaaaaagttgatgactatctggatagcgaattattctacggttgtcagagtcattctgttccatatctcctctgcctggtcttggtcctctaggaggaaaaccaggtcgttctctaggtcgttgttcacgcacacgaggtggctgagattgaacttctggtttagcttcgactcttggctgtgagactggtgctttaacatgggatggaattccagaggaagaaacagtaccactaggaggcaggtttttactggtcactgaagcccaggagaaagcctttggtggttcttgtggcagagaaacaggttctgccggaggaggagtagtagatttctcctctagttcttctaagttcttctcctccacttgtggtttcagctcttcagtctttgtttcagattctggctcaggttcaggttcatgagaggattcttccaaaggctcctctatgccattagtcacagggtgagcttcatagtaaccactgttagcattttcttgcacaggttcaggagatggttgtctttcttcttgttcctcttctacttcatcttctgattcttcatcaagttcaggctcagaatcaccaaacacttcatcttcataacgaaacatatcattgtgaacataaaatttatttggaacagatccttcaggagccagaacaaaggtttgcataaactttctttctggttgtccactgttagacagcaaacccatgacctggacaactactccatcactcaaggttgcatgagcatccacatgacgaattttagtatgacattcactgaagttcagagataatactttgtggtgtatatcattttggccataaacagcttcctggggctttccactagcatctactccaccatgaacataggaagaattcctgccataaaacctgtgtaaatattccggagctttattcagcaaagtataatattgcctcacaaactcccgccctacaagcagcggactgggcttctccataaccatttctttgctgcacaatgtcaaatgctccagccaacggcggcggcgggtacgtcncgcggaggtcagaagagtcgctgaggaccgggtgcggcgggttcttattgctcgccgcccccttcctccgacaactcggaagcctcggaagccggagagccgcgagttcgtctgcctcacaaccacctcttcccgggcccg

SEQ ID NO: 4561 - DNA, 1833 bp, Homo sapiens
  misc_feature (1)...(1833): n = A,T,C or G
tcagtgggcatgtccttntaagttcactttgtcgtagatagtttaagatatggtcatttctcagtccttaattctccaagtctagatttataaattaacaatgtgaatcctgttgtgaaattggggaaataatgtccacctcaatttaactgataaccaaagatgcttttcacatcaaagaaatgatcaaaaaggctgtgtcacattccaaagccaaaaaaaaaattaacaagaatgcaaacacgatgaataatgtaccactgccaagactttgccaacagtggagcttcagcgacgctgtcctgtgaagcggccctccatttgcccggttcctcttccagagccaagtttctgtgccatgccaccccttggaggaggtcctcttccatcacgatcacgcatcattccaccacccacaattccacgtggaccaccgggacctcgatcattgcgcctaatatccctgcgatcatcaccaccacctctggtttctcgctctcttgcagctcttgtttttttctcttccacatttaaacgtacttcccctcgaaacataatcggttttgcaattaagattctctgaactggttcagagtcatcaaaaaccacaaaaccgaaatttggaagctttcccccaacacccttggtattgatgcgaagttccacaacgtttccaaaactcatgaagaattcctttagctcattttcatcaatatcatgtggcaagttaccaacaaaaagttgatgactatctggatagcgaattattctacggttgtcagagtcattctgttccatatctcctctgcctggtcttggtcctctaggaggaaaaccaggtcgttctctaggtcgttgttcacgcacacgaggtggctgagattgaacttctggtttagcttcgactcttggctttggtggttcttgtggcagagaaacaggttctgccggaggaggagtagtagacttctcctctagttcttctaagttcttctcctccacttgtggtttcagctcttcagtctttgtttcagattctggctcaggttcaggttcatgagaggattcttccaaaggctcctctatgccattagtcacagggtgagcttcatagtaaccactgttagcattttcttgcacaggttcaggagatggttgtctttcttcttgttcctcttctacttcatcttctgattcttcatcaagttcaggctcagaatcaccaaacacttcatcttcataacgaaacatatcattgtgaacataaaatttatttggaacagatccttcaggagccagaacaaaggtttgcataaactttctttctggttgtccactgttagacagcaaacccatgacctggacaactactccatcactcaaggttgcatgagcatccacatgacgaattttagtatgacattcactgaagttcagagataatactttgtggtgtatatcattttggccataaacagcttcctggggctttccactagcatctactccaccatgaacataggaagaattcctgccataaaacctgtgtaaatattccggagctttattcagcaaagtataatattgcctcacaaactcccgccctacaagcagcggactgggcttctccataaccatttctttgctgcacaatgtcaaatgctccagccaacggcggcggcgggtacgtcncgcggaggtcagaagagtcgctgaggaccgggtgcggcgggttcttattgctcgccgcccccttcctccgacaactcggaagcctcggaagccggagagccgcgagttcgtctgcctcacaaccacctcttcccgggcccg

SEQ ID NO: 4562 - DNA, 704 bp, Homo sapiens
ttttaatgaaataaaggtcgggcttggtggctcatgcctgtaatcccagtactttgggaatgcaagctgcaagctgggagatcgcttgaggccaaaagcctgaggccacagtgggctatgatcatatcactgcactccagcctgagtgacagaggagaccatgactctaaaaataaaatactagagtacatataagaataagcgtgtgcatatatagatatgaatgtgttatgtaccagaatatgacataaaatgtttttattactgtgagttgcagttaaaaacactttttgccatcaaatgaataaaatattgaatacagtttagacatgtttacaaagatactgtcagataatgaggagacaggaaatgcaaaatatatatagtcatacccaagaaaaaaagtagataaaaataccaaattatttgtttaaaatttacctgtgtaaatattccggagctttattcagcaaagtataatattgcctcacaaactcccgccctacaagcagcggactgggcttctccataaccatttctttgctgcacaatgtcaaatgctgagggagcaaacacaagaataactattaaaaagtcatctttgtcatcaaccaccatgaaataaattttctttttagccaaatttagcagtggggagttgtataccaattttagtgacactaatgttaataagttctgataac

SEQ ID NO: 4563 - DNA, 320 bp, Homo sapiens
ttttttttttttttttttttttttttttttttttttttttttttttttttttaaaatgctagcccattttactgattttaaagatacttcaatttttatacatttcgatgatttttcaacattttgcagctgtttggctttgcagcacagcaattcatacactatactgtacaaaattaccagcaagactggaatgatgtattaatagaaggcaccatcatgcttattacattaccagagaacaaaaatacagtaaagacaattttcactgtacacagcttaaagaaaggaaaaaaggggggggggagtgtgttgagcag

SEQ ID NO: 4564 - DNA, 616 bp, Homo sapiens
cagtagtttattgtttgtttagtccaaacacattcaatatggaaactcaaagaatactttccacctgaaacaattaaactagattctactagcatataatgcttaacacattacagcaataaagatggtaatccattgtcttctatacctactaaagccaagatggtaaagccaatttggttgcaatagtgtcataaggatagaatattaccatcaaaaaataaaacaaaatcagcaaataacagtaatggtagatgaatatttttactctgtttcactgaaaagaggacaaaatgttaaaactccacagtactgcaggtgaacaatcaccatgtaaacttctccatatgatgttttaatgttttattcatggtatgtaaagactgaagctgaatggctctttgctctacttttctattattacacttaacatttgtcattacttttggtgccagaacagttttcatggatggcagggcaatatcctgaattggaaattatatatatatatatatatatatatatatatatatatatatatatatatatatatatggaaacagaaatacaagaaaatatgcttgggggaaaaaaaacattgacaataaaacaactg

SEQ ID NO: 4565 - DNA, 590 bp, Homo sapiens
gaatcttaagagaattaatttgtcaattttttttttttttttttttttgagacagagtctcgctctgtcacccaggctggagtgcaatggcgtgatctcaaaaaataacaaaataaaataaaataaataaaactatgcttgacacataaacctgatgtccaaaagatctcaggtctctccaaatctgtctttcatttgtcaaatgagagcactggccttagaggatcttgaagggaagtgggggggtgctgaagtaccccttctgaggccttgagtaaggcatcctctctctaagcctcaacttcctcatctgtagagtgagggtcataatagcatctgccttataggggatgatgaggatgaagtaaaacaatacaggtaagcatttcgcacagcacatggcttatggtgaaagtcaggtattattattattgccatcctctgcattacttatgacaacattgatcattgtttgcctcctggatttttgaaagggtaggatgctaaaagaaagccctcttagttgcatttgcaaatctctcaacagtgctgaccaagctctaatgcaaaagcaagcagatatgcaaagt

SEQ ID NO: 4566 - DNA, 1193 bp, Homo sapiens
tttttttttttttttttgaggtaggaacttttattatcacaagtccagagaggtaaagttacttgcccaatgccacacagcaagcaagtggcctgtccaggatgtgatcttaggtttgtctgactgcagagcccccaccctcactttccagtgtgtgtgagggggtcaggaacagagggaggactattgtaagcggagccccaggcactgtagggtcctggagaaataagggggcagtggtgccaggagctcaacaggggtgtccctggccctggtgcctgggagaaggagccgatgtaggtggaggtgcaagggcagctgggcagcctgggagggggtcaggtggaggcgtctgaggagggcttcatccaggacctgtctttggggcttgttgttctcagctggcagcagaaatcgctggcccaggacagtgcccacacgggcagagtacatgtggtccccaagcacagggcagagctgtagtaccatgtgcacctgtagttgactggagaacactgtcagtggctgcagctggaccagggcacagccagagcctgtggctaccacacgaaagtgactgagagtcttcttgacaccttccaggatgtcctttcgggatggggccttcactggaactgtgagattgaccccatcaatgtgttccagtttcagggcagcctggatcttcccctcagaagcagctgggatcccatcagtgacagcacagtaggtggctgtgggcctttgggctctccgtgcatgggtgaagtacttctggaggcgactacgtgtctggggacagctggagaggagtacaagcccagagctttctttcccagatgctcggacaacctgaagctcctgctccctgagccctagggactggctcagctctggcagcactgagaacaacgtcagctctcctggttttcctgtcactggtagaccctgtggcttgttcaacgtcactagaggtcctttccggtccaccacggctgcccgcagcgcatcaaccagctcctcccgactgaggttttttggcagcagccccgcgaagggctggtccccgaggggccccgaccgttggcaggagccgcggggttgcctctgatgccgggcttcggtgccaaagcctgcgtcctcgggcactgggcggacacccatggccccgccgccagccactccagaaccgg

SEQ ID NO: 4567 - DNA, 847 bp, Homo sapiens
  misc_feature (1)...(847): n = A,T,C or G
taaagatagggttttaccatgttgcccaggctggtcttgaacttctggactcaagcaatcctcccacctcggcctcccaaagtcctattgattataggcatgagccaccacgcggaaagttttgttgttgtttttccagagatggggtctattttgcccaggctggtctcgaactcctgggctcaagtgatcctcttgccttggcctccagaagtgttgggattacaggtgtgagtcactgtgcccagcgtcagggaggtgtcatgctttgcctggtatcacaccatttgtacttgaggatttgaacccagagccatcggcttcctcttcttcacagtacttgtatccacctctatgatctcaaaccttcccatggaaaatgtctcagcttatccccaagcagctgtttccccaccacagatggatgcctgtactcctaggcttcctgtcacccctaaccacttacttcccagatgctcggacaacctgaagctcctgctccctgagccctagggactggctcagctctggcagcactgagaacaacgtcagctctcctggttttcctgtcactggtagaccctgtggcttgttcaacgtcactagaggtcctttccggtccaccacggctgcccgcagcgcatcaaccagctcctcccgactgaggttttttggcagcagccccgcgaagggctggtccccgaggggccccgaccgttggcaggagccgcggggttgcctctgatgccgggcttcggtgccaaagcctacgtcctcgggcactgggcggacacccaagccccgccgccagccacttcanaaccggcccaaaacacggcggccgtcc

SEQ ID NO: 4568 - DNA, 294 bp, Homo sapiens
tgaggtaggaacttttattatcacaagtccagagaggtaaagttacttggcccatgccaaacagcaaggcaattggcttgtcaaggatgtgttctaaggtttgtctgactgcagagcccccaccctcactttccagtgtgtgtgagggggtcaggaacagaggagggcttcatccaggacctgtctttggggcttgttgttctcagctggcagcagaaatcgctggcccaggacagtgcccacacgggcagagtacatgtggtccccaagcacagggcagagctgtagtaccat

SEQ ID NO: 4569 - DNA, 251 bp, Homo sapiens
  misc_feature (1)...(251): n = A,T,C or G
ctttccggtccaccacggctgcccgcagcgcatcaaccagctcctcccgactgaggtttttttggcagcagccccgcgaagggctggtccccgaggggccccgaccgttggcaggagccgcggggttgcctntgatgcctggacaaggagggagaagcaatgggagtnattccatcccgaggtgccanccattcctatctccggacgcctcttcccaaatcctgcggcctctnaaaaatgcctcacaatgt

SEQ ID NO: 4570 - DNA, 533 bp, Homo sapiens
ttttttttttttggtggtgcttttaatcaatcttttattcacagctacaaactttaatcaattatggataaaacacaaaagctttttgaaatgctgataaaggaacccataccgagagaccaaataaaatccgagtgctgagctggccatgggcttggcaggtcagcagcacacggaggcacagagatggtggcaccaacagaaaggaatgtgggaaaattttgtcccccagataatatgaatagaacagtaaaatgaggttcagggttgaaatggcaaagccaacgcttgctgtcattctcttgggtcccttccatgtgctgggctacgattataaatggggcatgctggctgcatgccaggggctcctggccttccaggggacagacactgtcacaccagggctgagcaagtgccataaagtcagggttttgtttgggggccagggttaaagaccagcctgggcaacacagcaagatgccatttctacaaaaaaaaaaaaataaataataattatatatatatatatatat

SEQ ID NO: 4571 - DNA, 527 bp, Homo sapiens
aaacaaaatatttcataagtattccttcctgttttaatttttccatttccccaactttaattaattatacttacaaccatattttggtttatcttctaccaggatttcttccatgcatacaataaaatgtacaaacactcaaatacacaaaattttccttttttttttttttccccccagatgggagtcttgttctgttgtccaggctggaagtgcaggggcatgatctcagctcactgcagcctctgcctcccgggttcaagcaattctcccgcctcagcctcccaagtagctgggactacaggagaatgggttgaacccgagaggcggaggttgcagtgagccaggatcacaccattgcactctggcctgggtgacaagagtgaaaatctgtcccccatccccccacccctcccaaaaacaaacacacagcaatacaccacagttgtgtacatgaaaaggaattgctccaagtataacctcaaaatcaaaatgactataaacacgtaaagtatggcctttgatat

SEQ ID NO: 4572 - DNA, 601 bp, Homo sapiens
tttttaattgacacataataactggatgtatgtgtatatatatatatatatatatatatatatatatatatatatatatatatatatggtacagtatgattttttgacacatgcgtatcttgtgtgaaaatcaaatcagggtattccatttccaaagtcagcaacattgagccaagtccttctcgtgatgctatctctcaggctctctctctttagcagccttcttctacttttaaggacactggtgattccactgggttcgccgagatactccaagataacctccccttctcaagggggcaggtgatcaacaaccttaattgcatttgcaaccttaattctcccttgccatgtaacataccatattcccagatccaagggattaggatgtagagctctttgggttgtgttattctgccttccacacctgacaattctgcctccagatcaggatcgcaggcaaaaatgacacattctgacaataacgtgaaagtgggtctcagtatacaagcctcctgcttgctttacagttttatggtgagtattttacctgcccctgcaacttaggtaccaagcacagtgcttggagcacaccaggggc

SEQ ID NO: 4573 - DNA, 487 bp, Homo sapiens
  misc_feature (1)...(487): n = A,T,C or G
ttttttttttgtatttccaaaaagtactttattggtaaagatattaaaattatccagcaaccatcctttggtataaaaagttactatggtcactaatagtatgacagcctttccaccgagagtctgaggactgcatgcctcaatgaagcagagctattttgattaatgtatgccaacaaaaaagtaacaaaaactggatggatgtatgactagggaaatgatactgatcccatttgagaaggaaaattgatttccatcacatgaagagagcagtaaaatgatgaccaaatcctctcaatattttctctttttcatttatttatttatttattttttgaggacagagtctcggctctgtagcccgggctgggagtgcagtgggcgcgatctcagctcactggcaacctccgcctcctggggtccccggtttcaagcattctcccgccttcaggtttcccagtagctgggggttacagggctgtgncac

SEQ ID NO: 4574 - DNA, 540 bp, Homo sapiens
agcggccgccctccgtggaccaggttaccatgtccccgcccgcacgcccggccgggcagcccgagctcacgcgcgcccgcccacgtccgccggggtccctgctgatgctcggggggagtcctgtaaaagccacactgaggtcgcggcggcgagtccctgcaaggtcgcccttctgtgcgaacaggctttggtggttcttgttctaggaaacatccagcgcttcaactggccacggagttactaagtatcaaccgaacaaggtagttttaaaaggaagggaaatattgcgacacgaatgaagggacagattaacttgctcctcggatccgggcacacagctcctcctacttcttcttcctcttttcctggacacaccgtggacagaaccattttcctttgggtttcgtggtaaggtccacgcaggcaaagtgaaaccactcaattggacagtctggattgtcacagccaatcatctccccataggagacctggtggcacaggcagtacgtgggttcgtttgggtccacgggcatgttcagc

SEQ ID NO: 4575 - DNA, 509 bp, Homo sapiens
tcaggtttttatctttttatttatttatttgagacagggtcttgctctctcgcccaggctggagtgcagtggcgcgatctcagctcactgaagcctcggacttccaggctcaagccatcctcccgcctccgcctcccaggtagttgggaccacaggcacgcaccaccacgcccagctaatttttgtattttttgtagagttggggtctcccgatgttgcccagactacaggtttttatttaaatgaaatcattttcctttgggtttcgtggtaaggtccacgcaggcaaagtgaaaccactcaattggacagtctggattgtcacagccaatcatctccccataggagacctggtggcacaggcagtacgtgggttcgtttgggtccacgggcatgtccagcacatcagaggggtgcacggacaggatggtgtcagtgaactcagacctaagtctgtcctttgcaggtaatctgctcttctgctctttctctctgtctgggaatagaca

SEQ ID NO: 4576 - DNA, 408 bp, Homo sapiens
tttgtcttctaagtcttcatgtctacagtgttattttttgctattattttttgtttcttcgacagtgacataaactgaggtaaacatctgtgaccaacacctctcctaaggggcaaagggtcccagcccgaccagcagaggaggtggcagcaccagggccccaacctggtgttccggttctgctctggggtcaggctggaggctggccctctgggtgcctctgggaatgagggggctgggctacataactatggtcccctcccaactctaacatactagatactacaacggctggggaaactcccgaacaggatcttaacagagagagggagagagagaaagagaggagagagagagagagagagagagagagagagagagagagagagagagggagagagagagcgc

SEQ ID NO: 4577 - DNA, 5061 bp, Homo sapiens
  misc_feature (1)...(5061): n = A,T,C or G
ncggggccaanaattcggcccggggcaattttttttttttttttttttttttttttttttgtttgtaccaaaatatttaatcaatatgctgttaaaataaaaccaacaaaagaaacagtaatacaattttactggtttatatttcaattcataaagttgacacactgaaactaccttagcacaatgtccacacacctagcattagataggcttacagctattttggtaactgaacaagaaagacacagaaagcagcaaaggggatggttggtggggagggggttgccacttgttacctcccttattacagataacctcagcaagcgttagtacagccaataagaaaaagagctacaaaacaacccgagtgtctttatatacaaaaccagtgcctcttgtaagcagccgcctcaacactgaacgcagaaaacaggacaaaaccatctgcgtgtcagcctgtcagcatatcactatataaattaaaagtcaaagtttttttttttttttaaaggtgctaaaatccattccatagctttgaagtgagaacttacagcccatctgaacagtgaggtttgtacccaggcatactctgaggagggcccaaaggcccagcccatctgggagggacaggcccggaggatggagacctcgcagcatgtgcaccctgcgcagacatttacagacacgcaactcagtctttctcacttggacaacctgttgtgcaaaaacactaggaatcttgaagtgagggagctctgtccacagctcccgtaatggcagggaggagagcagagcccaatgaaccttgagtgaaattaagtgctcgaataaccacataattaaattgtgcagatcagcagtcctagtctggaatttaaacactgtcaacggggcatattgggaaagatatttatatatatatatatacatacacacacacacacacacacacacacacacacacacacaaacacattaagcaaaataagatttgtccatgttataatccagtctcacagtcaagtcacccaccccagccttttgaagtcatttggcagctaatgctaaaaagtaacaggaactatgagagttgcatagaattgatcagaaacatgaataatgccaaacccaaaacctgcacgatacagtttaacagaaccaggtggcttcagatgcaactatgaaaaaccctcctatttaaaacaaagtgcttctccatgtctacctgggggaccttctgctggcattgaagcagaaaagaattatttgaatttctgatcccttgccccacccccactatatatatatatatatatatatatatatatatatatatatatatatatatatatatatatatgtatattaaaaaaaaaaggtttagaaaaaaaatcaacagactgaaggatcccctaactctgatcatgtaaactcagcctttaggctgggtgaggtgttgacgtacacggggaagaggcctgggaggtcacactgaggagtgatttctagagtgtccagagcgtcggctgagctagcaggcctgttagtatcagtagtcttaccccagaggttgcctgcttcacaagctctggtccagtgacctaccaacatgcgtctatggatctgacttaggtacattctggtcctgggacaagtcacagaatcacacatctggccaaagaaggcaacaaaaggtgtcgtgttttctgaaggtgtcgggaggcggcagctgctctcagcaagtctctttcccttgaaccccggttgctgtctttatggagctcagtgttcggttaaaccacgtcttcttggctgcctgcacctcattgagggcaagccctaaatggtgttccaagtcctgtatcttacactcggcctccaccagctggagtttggtctgtgccagttctagctccatttctctcagctggttcttgagcgtctctttctcttcatccgtgtcctcatctaaaacctccttggttgagcttatgccttttacacgcccttctttgttgaaaaattcccggcaccgctcacagtcatccactttttgccgaattttctcaatttccaccttattggctgtctgctgcttctccaatctttcactcaactgagaacaaatctgcttatagtcaccaatgatagaactgttttttttaatctcagattctgccttgtcgagttcccgacggcacatttcttttaactgagcagactcttcttccaaccgtcttttctcttcttctgcatcaatcaacttctgtttggtcatcagcagctccttattcagagcatctgccttttcctcagcgttatccaggtccttccgtagtgcaatcttgctggtcaccagctcatgggctaagtcatcgttttcctgttccaacctcatgttagcttcttgtagacgcctattctcccgctcaaatcgctcgatggggtcttcttgctgggcctgctgttccctcatggtgtgatattctttctcgtattttttcaacttcttctgactaatcttcatgttgcaggctaattccattagtttttttgcattttcttctgagcggtatctcttaggaagctgaaccctaaagaacttcaaggcaccttcaaagtctgtcaacagcaggtcatctttcgaagtctttaataatccaagggcgacattaaaaataacacttattccctcacataaaagcaggtcgatgatatggaagaccatgtagagagggaattttgcagtgaaaagagtaagaaaccactgggaggcatacatgtgtgcttcaaggcttatatccaggaagtggttgtacaggtcaggaatgtattcctgcatgaggcgctccaactggtaaaatttgcaatgcaaatcttcgaagttttgcttgaaaagttccctgagcccatagtcaaacatgatcttgaccagaacactgaatgcctgttcttcaggcatatggagaaggagcacagcagcaagaaatgactggccctggcaataaccaatctcttcatcatacacagaataagccttgcatattttatataaggaatcttgtccatctcctcctgtgtccttaaagtagtcatgggctgggaatgttcggttaatatcccgggtgatagcactgtcctggggagactcctttgtgataagaatgcggtatttctctaccaggtggtcattgttatgacagcctgctagcagctgccagacttctcctcgaagagcttcagggacaccgtttcttactaaggatgacaactgcttcggtctcacattcaagttgagatgccattttgacaacagttctccccatgtttcaagaattttttctgcacattctttggatacatcaccagatccactcaggagaggttcatcattatcttcctcttcatcatcttctggaggagaaggtatcactgaactttgcgatccagactgtggcaggcgaactgaaggactggctgtagttttcctcctctctctttctgattcactttccaagcatacaacttcatataaagtgtcagtattattctttctctccctttgctttatctgttttagtttcaaaaagaaattttcagtagtactacgtttgctgaagggccagaataatctttcattaggtgagcaaacgcggacttttgtctccaggagaaatcgaacaggctcctgtacttctgttattaccaaatctacagctgtggtcataaacaggactttatctttaggaggttcttcatttacaacttgaaaatgtggggattttggattccagctccccgtaataacatacgactttccatctgaacttttgcccatagattccaaatctaataagtgcatgtcactatttcgtacatcttttcctggactaaggagaagaccaaaacacctttcaatggcaagttctttattagttgtttgctgcacatagatgacaatcttcttatcaattccttggcgtagtttaaagcactgtctgtccttatctttgggaactgcactaaaataacctttaccatcatcttcttttatttctaaagacacagagaaggtaaagatgtcactgtcaggagtctggggtgcagcagtggctgaaagtggggtctgcttggcagaacggcggaaggcagtggcaaaactgtaaagtatccggcttacagcttcttgtatttcacaccggaagacgtgtattctgaagagctctgcattgtaatgactttcagtgaaagcaaaacagtcactctcaggagttccatcatgccctctgacacagaagaggattttgtagatagggtagtttgctatttcagtgtttgtctgaggatctaagagtctcacaattccttcagacacattcggcactgaaagggtaacatctagtgaaatctgacactggcttcttaagatggacatcatccttaaggcttccacttcactcctgggagcatttaccgaggcacagcctaagtaagtcagtttactgaaaactacgctgtcctcatcggccactggtgtgaaaggacttgaagcttcagaatctccttgtccaggtttcactggtaggctcatctctggtttttggagccctactaatggcacagggttaatggtggaatgaagcggagagctgattagaaagaggcccatctccttcaccatccagttgtgaccttttcacaagctccttttcccctggctggtcgtccattggaggatccatcagtacatctgctagctctttttgcagctgctgttcacttccattccctacaatccttgagtcctgttttctcatcatcacttccattatttgtagatggtgtctcatctccttgcctggaaaccaagacaaaatcttcactatttaagagtagatactgagtctgaagaggacactgatttttccaacagaagccttgtcatccataagctcaagaatgagtctcaacacatgaatgattaaatattttttaatgcccgacctgccgtctcctcctccgccgcccgccgctcgccgtcccggagcctccgccgccctc

SEQ ID NO: 4578 - DNA, 2722 bp, Homo sapiens
tttttttttgtttgtaccaaaatatttaatcaatatgctgttaaaataaaaccaacaaaagaaacagtaatacaattttactggtttatatttcaattcataaagttgacacactgaaactaccttagcacaatgtccacacacctagcattagataggcttacagctattttggtaactgaacaagaaagacacagaaagcagcaaaggggatggttggtggggagggggttgccacttgttacctcccttattacagataacctcagcaagcgttagtacagccaataagaaaaagagctacaaaacaacccgagtgtctttatatacaaaaccagtgcctcttgtaagcagccgcctcaacactgaacgcagaaaacaggacaaaaccatctgcgtgtcagcctgtcagcatatcactatataaattaaaagtcaaagtttttttttttttttaaaggtgctaaaatccattccatagctttgaagtgagaacttacagcccatctgaacagtgaggtttgtacccaggcatactctgaggagggcccaaaggcccagcccatctgggagggacaggcccggaggatggagacctcgcagcatgtgcaccctgcgcagacatttacagacacgcaactcagtctttctcacttggacaacctgttgtgcaaaaacactaggaatcttgaagtgagggagctctgtccacagctcccgtaatggcagggaggagagcagagcccaatgaaccttgagtgaaattaagtgctcgaataaccacataattaaattgtgcagatcagcagtcctagtctggaatttaaacactgtcaacggggcatattgggaaagatatttatatatatatatatacatacacacacacacacacacacacacacaaacacattaagcaaaataagatttgtccatgttataatccagtctcacagtcaagtcacccaccccagccttttgaagtcatttggcagctaatgctaaaaagtaacaggaactatgagagttgcatagaattgatcagaaacatgaataatgccaaacccaaaacctgcacgatacagtttaacagaaccaggtggcttcagatgcaactatgaaaccctcctatttaaaacaaagtgcttctccatgtctacctgggggaccttctgctggcattgaagcagaaaagaattatttgaatttctgatcccttgccccacccccactatatatatatatatatatatatatatatatatatatatgtatattaaaaaaaaaggtttagaaaaaaaatcaacagactgaaggatcccctaactctgatcatgtaaactcagcctttaggctgggtgaggtgttgacgtacacggggaagaggcctgggaggtcacactgaggagtgatttctagagtgtccagagcgtcggctgagctagcaggcctgttagtatcagtagtcttaccccagaggttgcctgcttcacaagctctggtccagtgacctaccaacatgcgtctatggatctgacttaggtacattctggtcctgggacaagtcacagaatcacacatctggccaaagaaggcaacaaaaggtgtcgtgttttctgaaggtgtcgggaggcggcagctgctctcagcaagtctctttcccttgaaccccggttgctgtctttatggagctcagtgttcggttaaaccacgtcttcttggctgcctgcacctcattgagggcaagccctaaatggtgttccaagtcctgtatcttacactcggcctccaccagctggagtttggtctgtgccagttctagctccatttctctcagctggttcttgagcgtctctttctcttcatccgtgtcctcatctaaaacctccttggttgagcttatgccttttacacgcccttctttgttgaaaaattcccggcaccgctcacagtcatccactttttgccgaattttctcaatttccaccttattggctgtctgctgcttctccaatctttcactcaactgagaacaaatctgcttatagtcaccaatgatagaactgttttttttaatctcagattctgccttgtcgagttcccgacggcacatttcttttaactgagcagactcttcttccagccgtcttttctcttcttctgcatcaatcaacttctgtttggtcatcagcagctccttattcagagcatctgccttttcctcagcgttatccaggtccttccgtagtgcaatcttgctggtcaccagctcatgggctaagtcatcgttttcctgttccaacctcatgttagcttcttgtagacgcctattctcccgctcaaatcgctcgatggggtcttcttgctgggcctgctgttccctcatggtgtgatattctttctcgtattttttcaacttcttctgactaatctgtaggataaatcatagggtaaattaagaagtattagaaagtagtgggtgcttcagtgcctgcactgaagaccaagacttctggtggcctgggcaatctcagtcattatggatgtggtatttcctatttttttggagggaaatcatcagagtagggtataagcccaggaccccaaattctcaatgcgtttagagttctgttggagccgtctgtagggtgttcattctaatactgtcagttaaagccttaggacccaaacatctcaatgcgtttagagttctgttggagat

SEQ ID NO: 4579 - DNA, 463 bp, Homo sapiens
  misc_feature (1)...(463): n = A,T,C or G
cttataagtcaaatanctataatgatcttttcatcacaaatctctaaaaggattaatgctgaagctgaattatcacccccttacctttgtgataagaatgcggtatttctctaccaggtggtcattgttatgacagcctgctagcagctgccagacttctcctcgaagngcttcagggacaccgtttcttactaaggatgacaactgcttcggtctcacattcaagttgagatgcctaaaaataaggccataaaccataaatcataaaaggaagataagattctctaaagaatgttacttttatcaaagtcaatttaaatgggcttacaaatacgtggacaagggtaacaaagtaataaaaaaaaaaaaaaacgggcgggccgcaagcttattcccntttagtggaggggttaatttttagctgggcangggcgttcgttttacaccaaccctggacncgggg

SEQ ID NO: 4580 - DNA, 600 bp, Homo sapiens
ttttttcctcagaaaagatggctctttatttaatgaaatattttactgctatcacattgtttcaatccaaatatggcattatagtgccattctaaaaataaatctaagtcccatgtgatatgcagccttttagctatgttcatttccttttagggctcaagtttcccacaggaaaattattcagtgtttggcaaaacggtcccaaatcatgtataaataagacataaatgctaactgcactgtcaaccttttccgggtttgctactgttgattctccttcacagcaatccatcatggagaggcccaagaagcaggaaatactcaagtactgttacctttgtgataagaatgcggtatttctctaccaggtggtcattgttatgacagcctgctagcaggtgccagacttctcctcgaagagcttcagggacaccgtttcttactagggatgaacaactgcttcggtctcacattcaagttgagatgccatttatgacacagctctcaccatgtctcaagattttctgcgcacattcttggatacatcacagatacactcaagagagggttctcattatccttctcttcatcatcttctgg

SEQ ID NO: 4581 - DNA, 458 bp, Homo sapiens
agtgtttgtctgaggatctaagagtctcacaattccttcagacacattcggcactgaaagggtaacatctagtgaaatctgacactggcttcttaagatggacatcatccttaaggcttccacttcactcctgggagcatttaccgaggcacagcctaagtaagtcagtttactgaaaactacgctgtcctcatcggccactggtgtgaaaggacttgaagcttcagaatatattaaaaaaaataaccttcagttacgcaagcaatgcagcaatcctaacctccttgtccaggtttcactggtaggctcatctctggtttttggagccctactaatggcacagggttaatggtggatgaagcggagagctgattagaaagaggcccatctccttcaccatccagttgtgaccttttcacaagctccttttcccctggctggtcgtccattggaggatc

SEQ ID NO: 4582 - DNA, 329 bp, Homo sapiens
  misc_feature (1)...(329): n = A,T,C or G
ctattccaaagtaatgaanncacttggncttcaagtaaaacaaaaanaatttcctaggggnacaaaattcctttggaaatacattttttaatacagtgtaaaactatgccattagattgataaaagccaaaatttatatttaagctaaacttactaaaaatgcttacctttcaatggcaagttctttattagttgtttgctgnacatagatgacaatcttcttatcaattccttggcgtagtttaaagcactgtctgtccttatctttgggaactgcactaaaataacctttaccatcatcttcttttatttctaaagacacagagaag

SEQ ID NO: 4583 - DNA, 774 bp, Homo sapiens
gactcctttgtggttcagtacaaggacagggacgggcagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacggttgcccgaggtgacgccagcccaggggccccaccccgccttggggagctgtgggtgacagaccccaccccagactcactgcgcctctcctggacggttcctgagggccagttcgactcttttgtggtccagttcaaggacaaagacgggccccaggtggtgcccgtggagggccatgagcgctctgtcactgtcacccctctggatgccggccgcaagtacagattcctcctctatggcctcctgggcaagaagcgccatggccctctcactgccgacggcaccacggaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattact

SEQ ID NO: 4584 - DNA, 744 bp, Homo sapiens
  misc_feature (1)...(744): n = A,T,C or G
caaccatgttctttgtcttcccaaatcccagctcccctcccaccagccccagccacagaggcctccaagcctcccctggagccacgcctaggggagctgacagtgacggatataacccctgactctgtgggcctctcatggacagtccctgagggtgaattcgactcctttgtggttcagtacaaggacagggacggacagccccaggtggtgcccgtggctgcagatcagcgggaggtcactatccctgacctggaaccctcccgcaagtacaagttcctgctctttgggatccaggatgggaaacgacgcagcccagtctctgtggaggcaaagacgggtgagatgggcccctacacagctgagcctgaggccacagccttcccacccttctcttcactccctctgctgagtcttccctttgtccacctgctctgtctcatttgaaaagccacatggggctagcacagtgactcatgcctgtaatcccagcactttgggagtccaaggcaggtcaggagtttgagaccagtctggccaacatggcaaaaccctgtctctactaaaaagacaaaaattagctggatgtggtgatgggtgctaataatttcaactactcnggagtcttgaggggcaaagaatactttgaacccncnaaggtggaggcttgtccgggagcctcaaaaattgtgcccccttgtgactttcaaaaccttggggnggataataagncccnaacttccc

SEQ ID NO: 4585 - DNA, 676 bp, Homo sapiens
gtcactgtcacccctctggatgccggccgcaagtacagattcctcctctatggcctcctgggcaagaagcgccatggccctctcactgccgacggcaccacgggtgaggggcattccctgcaggtccctgctctgctcccctcaggccaagcagcagacggtcacttgtggtggctgccattaccattatttggccccagccactcggctcagatccagctccccacgtccctgcacaagcccctagcacagcccggcaggactcagccacgcaaagccctgtctccagacctctcaatcctgcccgtcgaggtcacccagtcttccagaaacagctcagccgtttcctctccgtgtctccatctcagaagcccggagtgctatggatgatactggaacaaagcgtcccccaaaaccccgtctgggggaggagctgcaggtgaccaccgtgacccagaactccgtgggcctctcctggacagtccctgagggccagtttgactcctttgtggtccagtacaaagacagggacgggcagccccaggtggtgcccgtggagggcagcctcagggaggtcagcgtgccgggcctggaccctgcccacaggtacaagctgctgctctacgggctgcaccacggcaagcgtgtgggccccatctcggccgtcgccattact

SEQ ID NO: 4586 - DNA, 6586 bp, Homo sapiens
ttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatgcacttatagtcccagctactcgggaggatgaggcaggagaattgtttgagcccatgactttgaggttactgtgagctgtgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacgcggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttggagaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaggtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagatttaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgacaaaaaaaaa

SEQ ID NO: 4587 - DNA, 852 bp, Homo sapiens
  misc_feature (1)...(852): n = A,T,C or G
nccccngggcntgcaggaattcnggcacgagatttactgtaagtaggaggtataaatgacactcttaaattggaaggaggggtgttttagtgtctgttttaggtcaaaattagtgattctatttttatcaaaagttttatcctgaagtttcaggaccactcttccttaataaacttgttaatggaaagcgagctttatgaacatttaaaaatgttgctgctgctttgttacttaaaaagaaagttgccaagagagacttcttagggaaaatatttgggttttttttccaaaaattgctgaaatattgttttgccatttttaaaaagtctcaggttattaccactctgccattaaatatttgtatgcctgcatttttaaaaattctgtgcatgtactttatggagtacattctatttttgttttcagataccctacaaccaattttttttagtaatcttttagaattgaaattatcataaatgatcgagaataatcatcacatagtttaagattgtatatgttgagtagtttaaaacaatctttgcattttacagtaagaatcaaagtcccttcagtgtgcctttgccagctaatatgtgaccagcaatgacaaccttgggagatttataaatatgatgctatgaaataggcacacagaacagggttgcaggaaagcgccttgtgcaaatcccatatcctctacaccgggaatatggggggggaaaccaagccatttcaaaaatcctccggcacctttgaaggtcgcatggcctgaccccgctcggcttggggttggtttcaaaccaggggatcccagggatctccctgcatccaaagggggccaattcgttt

SEQ ID NO: 4588 - DNA, 639 bp, Homo sapiens
  misc_feature (1)...(639): n = A,T,C or G
gcatttacagtaggatcaagtccccttcagtgtnctttgtcagtaatatgtgaccagcaatgacaacctggggatatttattaaatattatgtatggatataggcaacacagaacaggtttgcagtatagcgtcttgatgtaaattctcatatacttnnacacgagaatatggaggagaaaacaagcatttacatatattctttgtcactttgaagatgcatgacctgaactcgactgcttgtgtttgtttacatatcaggcatacccaggcatctcctgcagccagaggttccattgctgtctttgctcagtcctcttttaaaatatgaattagtggacaggcacggtgcctcacacctgtaatcccagcactttgggaggtcgaggcaggtggatcacgaggtcaggagatcaagaccatcctggctaccactgaaaccccatctctactacaaaaaaattagccgggcgtggtggcgggcacctgcagtcccagctactcgggaggctgaggcaggagaatggtgggaacctgggaggcagagcttgcagtgagccaagatcacgccactgcactccagcctgggcaacagagcaagactctgtctcaaaaaaaataaataaataaattatgaatg

SEQ ID NO: 4589 - DNA, 571 bp, Homo sapiens
  misc_feature (1)...(571): n = A,T,C or G
tttttttttttttttttcctctgactaggtaatttcgaatgacctatcttcaagttcagggattcttttgctggattctttcttttgttgaatctctctgttgtattttttaatttaattcactgaattcttcagttgcaggatttctggttggttcttttttttatgatttctatctctgttgaatttgtcattcacatcataaatccttttctgattgactgaactatctgtatttccttgtatatcattcaatttcttaaaaaatcataattttgaattccttttctgggcaattaggttggatttccntttcaggcagggtctgccactaggaaaggtggatggttccnttgggtggggcaaccctaattttcccatggctctctcaatatttctggggggtccctggtggttggaggtctgtggcacccgggtgggaacaaatcatctcttccctttttttgaggangaaggtctccanctgtcaccngtgctgggagtacagtgggcatgatcctggggctcactggcaacctctgtctcccaaggttcaaggcgattctcttgg

SEQ ID NO: 4590 - DNA, 995 bp, Homo sapiens
aagcctctccctcttcctctgctcccgcggggtctgtgctgagaataatggcccggttggcccgggacgagtggaatgattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccacctttgaactgtgggcacagcttctgccgtcactgccttgctttatggtgggcatcttcaaagaaaacagaatgtccagaatgcagagaaaaatgggaaggtttccccaaagtcagtattctccctcagggatgccattgaaaagtttatttcctgatgccattagactgagatttgaagacattcagcagaataatgacatagtccaaagtcttgcagccttcagaaatatgggaatgatcagattcctttagctcctaacacaggccgagcgaatcagcagatgggagggggattcttttccggtgtgctcacagctttaactggagtggcagtggtcctgctcgtctatcactggagcagcagggaatctgaacacgacctcctggtccacaaggctgtggccaaatggacggcggaagaagttgtcctctggctggagcagctgggcccttgggcatctctttacagggaaaggtttttatctgaacgagtaaatggaaggtgaggagcaaagtcttctgacacaccgtggacattttagaaaacagctttcttgagatataatccaggccaggcgcggtggctcacacctggatcccagcactttgggaggccgaggcggatcgatcatttgaggtcaggagttccagaccagcctgaccaatatgatgaaaccccatctctactaaaaatacaaaaaaaaaa

SEQ ID NO: 4591 - DNA, 696 bp, Homo sapiens
  misc_feature (1)...(696): n = A,T,C or G
gggctgcaggaattcggtacgagaaccntcgtcaaaancacctggccatcagatttctgttacgtnaattncctggncactcctgcnacgacatccgtggttaaccccaccaccncgaactgtgggcacagcttctgccgtcactgccttgctttatggtgggcatcttcaaaganaatagnatgtccagaatgcagagaaaaatgggaaggtttccccaaagtcagtattctcctcagggatgccattgaaaagttatttcctgatgccattagactgagatttgaagacattcagcagaataatgacatagtccaaagtcttncagcctttcaganatatgggaatgntcagnttncttttagctnctnancacaggncgngcgnatcagcanttggggaggggngttncttntccctgttgtnctcanangttttaacnttggagttggaagncngtccctnanangtttantcaactgggntgtagcatangggtnttttntnccactggccttcattgggccaccaatgggttgttggccaaaattggnccgnctggnnggantgtntgnccctattgggttggtgngannattgngccntattggngattgtttnttnntggnanntggnttntnnnnttannggntaatntgnatgtttngngtgnantntttattttgaaacnagngg

SEQ ID NO: 4592 - DNA, 486 bp, Homo sapiens
tatggaaatcattgaaggtctggatccctttctctgaatggagagattgagagggatgtcgggcagttcccattagatttagtggccttcatgttattcagaattgttttggtgatacctcacccctgtaatcccagcactttgggtgggtgaggcgggcggatcacttgaagccaggacttcgagaccagcttggccagcatggtgaagcctcatctctaccccaaatacaaaaattagccaagtgtgatggcacatacctgtaatcccagctacttggaattggaaatcgcctgagcccgggaggcggaggttgcagggagggaggctgcaccactgcacttcagcctgggtgacagagggagactctgtcttaaagaaaaaaaagaacctcgtgccgaattcctagacttcaggtgcaaaatccctatagggggtagtataaaatcgtaaacctgtaatagtgtttcccggttaaattttatc

SEQ ID NO: 4593 - DNA, 474 bp, Homo sapiens
gtctggatccctttctctgaatggagagattgagagggatgtcgggcagttcccattagatttagtggccttcatgttattcagaattgttttggtgatacctcacccctgtaatcccagcactttgggtgggtgaggcaggcgtttcaccgtgttggccaggatggtctcgatgtcctgacctcgtgatccgcccgcttcggcctcccaaagtgctgggactacaggcgtgagccaccgcgtccagtccttattatgattattttaaatttctgcctcagtatgtttctattcccgtatgtttgcctttgctacaaggacaaaatacggaaaatatgtactaagcctccgtggctgttttgcaaatagaaaacccacagttgcaatggaaaaacccagcgggctgccgaggtaaatagcatcttggatgctccagcttgatactaataaaagtaaaaatggcaggattgaaaa

SEQ ID NO: 4594 - DNA, 490 bp, Homo sapiens
  misc_feature (1)...(490): n = A,T,C or G
atagattatttcagattttttgcttttacccacaggactataatacatntcttgtcagttctcctagggtagctatatattattagatgttgactatcagggcttttttggcctctaaacatgatatttagtcaaacaactgtcttaattttttttttctattctccatagggatgccattgaaaagttatttcctgatgccattagactgagatttgaagacattcagcagaataatgacatagtccaaagtcttgcagcctttcagaaatatgggaatgatcagattcctttagctcctaacacaggccgagcgaatcagcagatgggagggggattcttttccggtgtgctcacagctttaactggagtggcagtaagttgatcactgtgttcctctgccccgacccagaagcaggtcgtctacgaatggtttagcgccaggttccccacgaacgtgcggtgcgtgacgggcgagggggcggccgct

SEQ ID NO: 4595 - DNA, 470 bp, Homo sapiens
gaataatggcccggttggccgggacgagtggaatgattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcaggttgcttttaactttgacagaggaagaattttccaagacgccctataccatagaaaacagcagccacaggagagccatcctcatggagctagaacgtgt

SEQ ID NO: 4596 - DNA, 1795 bp, Homo sapiens
tggagctcgcgcgcctgcaggtcgacactagtggatccaaagaattcggcacgagctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgacctcaagaccgtgcctcagtttgtttgcaactgtttgttttactgggccctgtactttaacccaattattaacattgatcttgtggtcaaggaactccggcggctggaaacccaggtgttgtgactggcactgcccaggctgagactcttcaagtcccgctgacgtctgagctttgatgcttaagaggggtgaggcagggagcggacttcctattttctaccctcagtaaaacaaggtgctgctttgtatatcaaaagctccaaccatgtcctctccccctcagcctgtgggtggcacgagcaaggactgacatccgcacagggaggattgtctgtttggctgacacagcagcagcccttcccacccagccaccttcctcacagggactaggaggctcagtccccaacggctggcaagactcagggtcctcagtggacatggtgtgggtgacatcagaagggtgccacatcagtcccctccccaacctcagtgactgacagaggatccggatctcagagcctgagaccaggtttattggggcctggcctgtcctctaagtcaagtttaggaaaacaaggataagattctgtcataggcatagagagttgcacataaaaaataccgaagaaaacccaaaattcaatcaacaattctgtcttattgaagagttgctaggattcagagtaaaactcaaaggattcagtttgagcctagaatgatggttagacttgtagtcactgggcttttgttttgctttatggaaatcattgaaggtctggatccctttctctgaatggagagattgagagggatgtcgggcagttcccattagatttagtggccttcatgttattcagaattgttttggtgatacctcacccctgtaatcccagcactttgggtgggtgaggcaggcggatcacttgaagccaggacttcaagaccagcttggccaacatggtgaaacctcatctctactaaaaatacaaaaattagccaagtgtgatggcacatacctgtaatcccagctacttggaattggaaatcgcctgaacccaggaggcggaggttgcagggagggagactgcaccactgcacttcagcctgggtgacagagggagactctgtcttaaaaaaaaaaaaaaaatcatctgtaaaataaattccgggatagtcgttttgttcaaggaaatgttttgtaaattgagctcacactatataatctttattgtcctatcctgatgtataatacagcaggtataattacaccaagcgctatagttataaatatggcatgaagtgaactatggccttttatttccttccagtgtgaacacagcaggtgtgagatgtcatcttggaagacaggccttgcagaaataggcctacatccaaaatattatcttgtgactccatgaaccattcattaaccctttgtatctttgagtgaaaattttactcaaaagttgcatctggaagttcgaagaaattacttgaaataaaaataaagatttctatatagataaaaaaaaaaaaaaaaaaaagggcggccgct

SEQ ID NO: 4597 - DNA, 751 bp, Homo sapiens
cacagccttgtggacggcggaagaagttgtcctctggctggagcagctgggcccttgcatcatctttacagggaaaggtttttatctgaacgagtaaatggaaggttgcttttaactttgacagaggaagaattttccaagacgccctataccatagaaaacagcagccacaggagagccatcctcatggagctagaacgtgtcaaagcattaggcgtgaagccccccagaatctctgggaatataaggctgtgaacccaggcaggtccctgttcctgctatacgccctcaagagctcccccaggctgagtctgctctacctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagtaagtatgttttaatggttgtcacaacaggggatgggaaagaaataccaagtgagagaaagatcctcttttatttctcacacttgaaataaatcctccatccacccagaaaaaaaaaaaaaaaaa

SEQ ID NO: 4598 - DNA, 728 bp, Homo sapiens
gagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagaccgtgcctcagaggatgtggagccatttctggaaagtatcaacgcaggggctttttgtggccatgttctggcccctcatccctcagtttgtttgcaactgtttgttttactgggccctgtactttaacccaattcattaacattgatcttgtggtcaaggaactccggcggctggaaacccaggtgttgtgactggcactgcccaggctgagactcttcaagtcccgctgacgtctgagctttgatgcttaagaggggtgaggcagggagcggacttcctattttctaccctcagtaaaacaaggtgctgctttgtatatcaaaagctccaaccatgtcctctcccccttcagcctgggtgacagagggagactctgtcttaaaaaaaaaaaaaaaatcatctgtaaaataaattccgggatagtcgttttgttcaaggaaatgttttgtaaattgagctcacactatataatctttattgtcctatcctgatgtataatacagcaggtataattacaccaagcgctatagttataaatatggcatgaagtgaaaa

SEQ ID NO: 4599 - DNA, 437 bp, Homo sapiens
gacagctctgggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaatgtgaacacagcaggtgtgagatgtcatcttggaagacaggccttgcagaaataggcctacatccaaaatattatcttgtgactccatgaaccattcattaaccctttgtatctttgagtgaaaattttactcaaaagttgcatctggaagttcgaagaaattacttgaaataaaaataaagatttttatatagataaa

SEQ ID NO: 4600 - DNA, 474 bp, Homo sapiens
tgagaggaaagtcaaagaaatgttttcccctatattcttttcttttcttttcttttttgtgacagagggagactctgtcttaaaaaaaaaaaaaaatcatctgtaaaataaattccgggatagtcgttttgttcaaggaaatgttttgtaaattgagctcacactatataatctttattgtcctatcctgatgtataatacagcaggtataattacaccaagcgctatagttataaatatggcaatgaagtgaactatggccttttatttccttccagtgtgaacacagcaggtgtgagatgtcatcttggaagacaggccttgcagaaataggcctacatccaaaatattatcttgtgactccatgaaccattcattaaccctttgtatctttgagtgaaaattttactcaaaagttgcatctggaagttcgaagaaattacttgaaataaaaataaagatttctatatagat

SEQ ID NO: 4601 - DNA, 497 bp, Homo sapiens
ttttctggtatctagaaacatttaatagggacttagaaacagaagccacacctgtggcttgtgcagcagtgaggcaagatgatgggttcccacactattagcccccagacccagaggggtttatctattgtaggggagattacatgtagaggagaggtgcacatgcttcagagggaatgggtagaaatttgccctaatagcaggatttatgataagtacttgttcttacacaagggacagtagataaattggaaacctcagaggccctccagaaactggggttaatcagaagccaacactggcagattagcatccaagatggagttgctttagcctccagattccactccactaatttggcttttataatctcacacaccctcatcttctgttatggtctctgagcatttagggagagtacttgataggatataggtttagcagaagtgcattggtgatgggaaacagatcaggcccagtggggttccaaatgaaga

SEQ ID NO: 4602 - DNA, 4357 bp, Homo sapiens
  misc_feature (1)...(4357): n = A,T,C or G
agcnggnaagctaccggctgctggggtgccccggattttgcggggttcgtcgggcctgtggaagaagccccgccacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgacgacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggtggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggcctgggcaccggccatccccaaccagccacccacagcggcccacactgcaaactttctcctcaacgcccagcgggagacatcgactccagcccccagcaggacagcatctttttatgagtccatggtcgatgaggtcagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctatcctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagctgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgaaccgcgaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcaaaaaaaaaaaaaaaaaaaaaaaaaaaaaaaaaa

SEQ ID NO: 4603 - DNA, 3456 bp, Homo sapiens
gggttcgtcgggcctgtggaagaagccccgccacggacttcggcagaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccagaacttggtagtcaagccagaccagctgatcaaacgtcgtggaaaacttggtctcgttggggtcaacctcactctggatggggtcaagtcctggctgaagccacggctgggacaggaagccacagttggcaaggccacaggcttcctcaagaactttctgatcgagcccttcgtcccccacagtcaggctgaggagttctatgtctgcatctatgccacccgagaaggggactacgtcctgttccaccacgaggggggtgtggacgtgggtgatgtggacgccaaggcccagaagctgcttgttggcgtggatgagaaactgaatcctgaggacatcaaaaaacacctgttggtccacgcccctgacgacaagaaagaaattctggccagttttatctccggcctcttcaatttctacgaggacttgtacttcacctacctcgagatcaatccccttgtagtgaccaaagatggagtctatgtccttgacttggcggccaaggtggacgccactgccgactacatctgcaaagtgaagtggggtgacatcgagttccctccccccttcgggcgggaggcatatccagaggaagcctacattgcagacctcgatgccaaaagtggggcaagcctgaagctgaccttgctgaaccccaaagggaggatctggaccatggtggccgggggtggcgcctctgtcgtgtacagcgataccatctgtgatctagggggtgtcaacgagctggcaaactatggggagtactcaggcgcccccagcgagcagcagacctatgactatgccaagactatcctctccctcatgacccgagagaagcacccagatggcaagatcctcatcattggaggcagcatcgcaaacttcaccaacgtggctgccacgttcaagggcatcgtgagagcaattcgagattaccagggccccctgaaggagcacgaagtcacaatctttgtccgaagaggtggccccaactatcaggagggcttacgggtgatgggagaagtcgggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcgacgccagcccccagcaggacagcatctttttctgagtccagggccgatgaggtggcgcctgcaaagaaggccaagcctgccatgccacaagattcagtcccaagtccaagatccctgcaaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcactggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccagatccggaccatcgccatcatagctgaaggcatccctgaggccctcacgagaaagctgatcaagaaggcggaccagaagggagtgaccatcatcggacctgccactgttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtacccgggctccacattcatggatcatgtgttacgctatcaggacactccaggagtcaaaatgattgtggttcttggagagattgggggcactgaggaatataagatttgccggggcatcaaggagggccgcctcactaagcccatcgtctgctggtgcatcgggacgtgtgccaccatgttctcctctgaggtccagtttggccatgctggagcttgtgccaaccaggcttctgaaactgcagtagccaagaaccaggctttgaaggaagcaggagtgtttgtgccccggagctttgatgagcttggagagatcatccagtctgtatacgaagatctcgtggccaatggagtcattgtacctgcccaggaggtgccgcccccaaccgtgcccatggactactcctgggccagggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcgataaacaacccagacatgcgagtgcagatcctcaaagattacgtcaggcagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggggttcattggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtcagacagctggcagtgg

SEQ ID NO: 4604 - DNA, 3015 bp, Homo sapiens
accttgctttaggcacactgcttggtgagtttctaagaagcagagggggaaaaaaaatcacttgtcaattaatccagcttccttaattttactgaagaagaatttctccaggatattggcacatttgtagtattcactctcagcggcgttgtactctttgcaattggtaaagactcgctgtaagtctgccatgaataatttcttagacacgtagtacctattcttgaggcgttcactcatggttttcagatccatggggaaccttataacttcataatatcctggagcttctgttctcttcacaggttccatgaagggccaagcgctttgatggctcttcacctgctggaggatgctcttgagcgtgctgtaaagctggtcagggtctctgggctctttacttttctcttttccactcggtttccagcctgtctctctaattccaggaatgctttctataggaatctgtcgaactccatctttaaaacatgaaagtccagggtaaacttttcgaatttgtgcctgttttctttcaatcagttttttaattatctccttctgctttttaatgatgacagaaaattctgtgtacgggatccgtggatttagctcacatcccattaaagtggctccttcataatccttgatatagccaacatatttggttttaggtattttaatttctttggagaaaccctgtttcttaaagtatccaattgcatattcatctgcatatgtgaggaagttcaggatgtcatgctttatgtgatattctttcaaatgattcatcaggtgtgttccatagcccttgacttgctcatttgaggttacagcacagaagacaatctctgtgaatccttgagatgggaacatacggaaacagataccaccaataacacggccatctttaattaaagcaagggttttgtgtttcgggtcaaagacgagccgtgtgatgtattcttttggcattcggggcagctggtgggagaaaacgttctgtaggccaaccagccacatcaggatcttcttgtttggtttctggttgagggaattgccaaccacgtgaaattcaattacacccctgcgctcttccaaccttgccgcctcatccctggccgagtgtgctgacagaaaattggtctctggtccaagcattgctgcagggtccgtgatggtagacataacctcgttgattaattccatcggaatatcccccataactcggggtttcttggcctcctccagaacatgagaatcagtcattttcctcttttctccttgggtttgcctcaagtccagaagaggctttgcaggcaggactgctgctccctgcgtttggctgctcaagggaagatgaggttgaattgtatgaaattgtcccagccacaggaggtggattgataactgtttggatgcctagctggctggttctggaagaggctgagagaaaatcctgatcccagatgggagagttttgactatatacttcttcttctagcatggacagaaattttgggaaatgagtgaggattagagttcgtttttcaagaggcagtttatctttttcctgtcttgcttgttccaggagttgtcgcctcataacagtgaagaccgagcgaagcaatgttctcccaaacacctgtgtggtttcgtaccgaggtagactgtcgcagaactgtggcacgttgcagtaacacagccaccttgtgtagttctctttgtatccagaaatatcatcattgggagatcgcagtcttcgttgagatggtgcctccagatgccaatagttgatgcggtttaggaacatttttgccaactcaactattgtttgcctttcttttgctggcaggtgactaaatttgtactgcacaaagttattcacaccctgttcaatgctaggtttttcaaatgggggtttcttttccaaagagccttcaaccacaggttttcctctttgtaaaatagactttctcaagagcttaaatagatagaaataaacttgtttggtatctgcatcttcttccttgtggacacaggtaaagagatattccacatccaatactattcccaggagtctgttcatttcttcctctgacacattctccaggtgggaaacatgagcagctagggcatggctacaactccgacaggattctgttagactgacaattatttgctgcaggtcggctctggggggagtgggtgaggggttagggtttttccagccattacatttacaagactcctcggccttgcaggcggagtacactccgagtttctccagtttcttggcccgcggagcggagcgtagttgcgctttcttcacggcgattcgggccgagccaccgcctcccggtccttcggccgtgcccgctgcagccactgccgtcgccggaccgcaggcgcccgagcccccggcggcagcggcgcagggggagccctgcgggggcgcgggcggaagcgccgcaggctgcgggggcagcgccccgggcccggcccctgccccggctcctgccccgcagccgcccggcccggccccgccagcctcggacatgccgccccggagcacggcaggaggcgccgagtgtcaggcgccgccgccgccgccagggtctccctcgggctctggtagtcgggagagcgagaccctccccccacgccctcccgcccccttcgcccacccccctccccgcccccgccctccccctagcgcgccgctcgcccggctcgctctggccgggccccgcgcgctgatggtggtggcggcggcggcagcggcggcagctgctcccccaggagggaggggactagcggctccgctgccgctgccgccgccgccacagcacacgccctcccttggttctcctgcccgggactctgctccgcgccctggctgcggacatgttcctcgggactgcggactaggtgtgcgtgccggcggctgccagcctcacggtgtctgccagcgctgggaggccccccacggcctcttttccgcgtcgacgcggcccc

SEQ ID NO: 4605 - DNA, 1326 bp, Homo sapiens
tttgagactgagtctcgctctgtcaccaggctggaatgcagtggcgtgatcttggctcaatgcaacctccacctcccaggttcaagcgattctctggcctcagcctcttgactagctgggactacaggtgtgtgccaccacatccagctaatttttgtatttttagtagagacggggtttcaccatgttggccaggatggtctcaacctcttgacctcgtgatccacctgcctcggtctcccaaagtggtgggattacaggcgtgagccactgtgcccagccagaaaagcatttttaatagaattttgatagctcttaactgagatcctaaatcaaggatttagaaatgaggtatcataaagaatagtaagattttaaagctctcaaaattacatatgatacaaataaagattgtaacagtatttaatcattgtttcaaactttattacttaatgaaacagtttctatatactgcttccaattactttaatccttttttctcgttaaattttttttgttgttcttcagttgagctgagatacttttaattactttttattaactgcttccagaaaccgtaacaggtgcaggaatagattgatgatatccaagtagaggctgatggcagctaatacgtactcttcaggtgacagtttatgcatcagtgagtgtgtgtcatagatgatgaatccacagaaaagaagggctcctgcagcggctaagaccaactccattatctcactataaaaaaaaaacttcaagaatcctgacaggcacaatatccacaaaagagcaaacagccctgctccaaatttgctgaaatccttcttagattgtagagtatacacagtcaaaccaaaaaatactgtagtagtcagtatgaaagcttgcagaataatatatacatcatagaaagtaacaacaactgccacagtcagagcttccaacagcgtaaatccaaaaagtaggtacaggttaaggggatacttatgtctgtttaaaagtcaacgcaaaaatcaaacccagagatccgagggcaaacagcaaaattaaggcaggactctcatgtacaaatgtccgtacagactcaaagtataaaaaaactgttgaagtcactgtagttaagagaacctgcagagaaagaatgctgtagacttttctcagaaaggccattcggatgtgcacggtggcggaggccacgctgctgccatagttgaagtcgtcctcgatcgaggagcgagggtaccgggggtcggggtcagccatgatggcaacagctacccctaccggtcccggtccaacgtgggagcctacactcgaccacat

SEQ ID NO: 4606 - DNA, 1993 bp, Homo sapiens
aactcctgacctcaagtgatcccccaccttggccttccaaagtgctgggattacaggtgtgagccaccaagactggccacccccattttaggacaagagaagagaggtgataaggaactgctatttcaaaaagatgaatgggagggaagggaccagaaagtgacatcatcagggaacacttgattcaggcatgggtagcaagttcagttaccttactcctggcagcaacaggattgggggagggggtcttggagaagattttgtctgcaaatgtcgcaacactgttgcagtgtgagtatgacccaaagtcggcttggcagggggacaggcctgctgcttccctgcattctgggctgacctcttcacctgagtcggtcagtggacgcttttggcctccttcctggagctagacagctgttaggcttagggagcagctccggacctacagggttggggtgcaggtagggagggaggctgcagcatgtcagagtggtaaatacatgtcctgatttccaggactgatttcacatattctgccccacaagttcaccagcacctgtcagattggatgtcccagtttttggtttggaaaattcgatctgtctcaggtaatggagaagggggagacagcagttcattcattccagtgtctaagcctgtggttggtgggaacaagagactgtctgggatggctccagcccttcgctggaatctcgcattgaattcctacgtccgccctgatccgtgctgaggcgagcaggtgagtgggacggacagcgctgtgcctgcaccctcctagccccacttgcttaccgcggcccctgccttatcccacactgggaagtatgctctgttagcctcggctcagccttgcctcatcggcccagtggggagagtccagggaggagagaggctccacgtgctaaaggaaagcggcctgccagacactgctgcttaaggagactgtctaagcaatcggattcggtgcgggcgagatgcagacgtccgtttctcccaagggaaggagcaagggtactccaggtcccaaagctgcgttacagccagttgggctaatcccacccgcccctcccccaactccccgagtggcaatctgtccagcccctcaagcgatcaggccacaacccccagcaccgcgcgttctcctcccagcctagccggccatctccccaccgccccggcccgcaggtcccaagaggcggtggacgggccagcgggactacaagtcccagcagccccggggccgccctcgtgggcggagccaagccagcagcgaattgggaggagccctggcgctcaggctagggaacgcgtgtggccaatcgcggggccgttctcgccgcgagccgatgggggcggggaaaagtccggctgggccgggacaaaagccggatcccgggaagctaccggctgctggggtgctccggattttgcggggttcgtcgggcctgtggaagaagcgccgcgcacggacttcggcagaggtgagcacgggaggctgttttcgctggctggagcccgctcgccctaggagcttcctgcctccgtcccccaacccggaaccgccttccccgacgcgggctcggtgcccacgcgccctgctcggaagttttgagggtcttagctttaggttagccttcgcccggggtcccggccggtggcgcgtgtcgacgcccctcccctccccccgcgcgacacacacatattccagttcctgggagtttgcatggggcttgcgccatccttgcctcttctgcctctgccacattgcatggtccccctcctgggcgcgctcaccctcccgggcacagctatcgaggctcctcgggctcatcgggacgccttttggctccatccgggttcccccatcggatgccgggacgggaagtagagaaagcggtggcgactggtcccactccgattcctcactggcggctcaggcccttcttggttccgtgggtacaaaattgagctc

SEQ ID NO: 4607 - DNA, 488 bp, Homo sapiens
gagcgaggcaggaagctcatctacgcggggcagccccaccctgaggtctcaaagaagagatgggcattggcggggtccctcggctccttctggttccaaaaaaggttgctaagtacttcttgccagttcattgagatgtgtctgatggtgacagctagatcaccggcccagccgtctctggagcccacaaccccccatctttgtgcgcgagctgggaaagacctggtctccagcctcacctcggggctgctcaccatcggggatcggtttgggggtgccttggatgcagcagccaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaat

SEQ ID NO: 4608 - DNA, 658 bp, Homo sapiens
  misc_feature (1)...(658): n = A,T,C or G
ttttttttttaatccagcttccttaattttactgaagaaaaatttctccaggatattggcacatttgtagtattcactctcaggggggttgtactctttgcaattggtaaagactcgctgtaagtctgccatgaataatttcttaaacacgtagtacctattcttgaggcgttcactcatggttttcaaatccatggggaaccttataacttcataatatcctggagcttctgttctcttcacaggttccatgaagggccaagcgctttgatggctcttcacctgctggaggatgctcttgagcgtgctgtaaagctggtcagggtctctgggctctttacttttctcttttccactcgggttccagcctggcttttttaatcccaggaatgctttctataggaatctgtcgaactccatctttaaaacatgaaagtccagggtaaacttttcgaatttgtgcctgttttctttcaatcagntttttaattatctccttctgctttttaatgatgacagaaaattctgngtacgggatccgtggatttagctcacatcccattaaagtggctccttcataatccttgatataccaacatattttggtttaagattttaaattcttggagaaaccctgtttcttaagnattccaattgc

SEQ ID NO: 4609 - DNA, 612 bp, Homo sapiens
aattcacttccctttcactataggagagaagcaaataaggcaaagccactttccatttctgtgtatgttctaggagtaggacctggccctagtactcaaagagatgatctcttattaccctccattttaaaagacagtacccaaaaataacagtgtagcacattcctcaaaaccacctataataattaaagacatctatctattatatccaagaatatatacaacttaccctgctccaaatttgctgaaatccttcttagattgtagagtatacacagtcaaaccaaaaaatactgtagtagtcagtatgaaagcttgcagaataatatatacatcatagaaagtaactgtaaaattaaaacactgattaacatgcatataaacatgctcaatacaaaacagctttttctggcattttatagaaatgcttcattttctcctgtactttatgccaataaaaacaattagaaaagatttcttatccatccttgactacatgggtacagtgaaaccacacccataatgcaattaacagtctccaaaaaattcattcatacaaaatcagaggtcacattattaccaagttaatgaaatgactggagagctatcacg

SEQ ID NO: 4610 - DNA, 434 bp, Homo sapiens
  misc_feature (1)...(434): n = A,T,C or G
anccaaacttgcccnacaagttcaggaagctttcccaaaccggcgttaaattccnaaaanaagttaggttaccaggttttaaagggggaatnctttatggtcttgttttaaaaattcaacggcaaaaattcaaaacccnagagatcccgaggggcaaaacagcaaaattaaggcaggactctcattgtacaaattgtccgtncagacttcaaagtataaaaaaacttgttgaagtcactgtagttaagagaacctgcagagaaagaatgctgtagacttttctcagaaaggccattcggatgtgcactgtgnnggaggccacgctgctgccatagttgaagtcgtcctcgatcgaggagcgagggtaccgggggtcggggtcagccatgatggcaacagcnacccctaccggtcccggtccactaancgcaacc

SEQ ID NO: 4611 - DNA, 525 bp, Homo sapiens
tttcgcttcaaactttattacttaatgaaacagtttctatatactgcttccaattactttaatccttttttctcgttaaattttttttgttgttcttcagttgagctgagatacttttaattactttttattaactgcttccagaaaccgtaacaggtgcaggaatagattgatgatatccaagtagaggctgatggcagctaatacgtactcttcaggtgacagtttatgcatcagtgagtgtgtgtcatagatgatgaatccacagaaaagaagggctccttcataatccttgatatagccaacatatttggttttaggtattttaatttctttggagaaaccctgtttcttaaagtatccaattgcatattcatctgcatatgtgaggaagttcaggatgtcatgctttatgtgatattctttcaaatgattcatcaggtgtgttccatagcccttgacttgctcatttgaggttacagcacagaagacaatctctgtgaatccttgagatgggaacatacg

SEQ ID NO: 4612 - DNA, 726 bp, Homo sapiens
tgattttggatatgagacaaagcgtaaaataaagagtatatacagtgacattaacagtacccatcaagggcatggaaaatcaagaattgtggtaagtagaatttctccctctgaaagtacagcagtcaagtagtttaatctaacttctttcattattatcctgaataattattcaaaggaatacctatttacgacagacgcaaagcatatcaagaggataagctgatgtttttctatttgcaccaaagagttagaatataagcaaagttatatctaaagtgccagctttcaaatctagtgctgtctgcagttaccgtggattttctgcgtctagtgtcgttaagctcatgtgggctctaaacgacagctgcagaatgtctctaatgaacacagccacccacttctctgccatcactgacccgccacggtgcatggaatcccaccacccgtcatacacttcctaccctaagcagaggagtacaaatcaacctcagcaaccatttgtcccccacaccgccatccagagttttaaatctatacttagaaaatgttaatggtattacccatggggaaccttataacttcataatatcctggagcttctgttctcttcacaggttccatgaagggccaagcgctttgatggctcttcacctgctggaggatgctcttgagcgtgctgtaaagctggtcagggtctctgggctctttacttttctcttttcc

SEQ ID NO: 4613 - DNA, 975 bp, Homo sapiens
tttcattgtttcaaactttattacttaatgaaacaggttctatatactgcttccaattactttaatccttttttctcgttaaattttttttgttgttcttcagttgagctgagatacttttaattactttttattaactgcttccagaaaccgtaacaggtgcaggaatagattgatgatatccaagtagaggctgatggcagctaatacgtactcttcaggtgacagtttatgcatcagtgagtgtgtgtcatagatgatgaatccacagaaaagaagggctcctgcagcggctaagaccaactccattatctcactataaaaaaaaaactatagggaagagattaaagaaatatgtttatatttgagaacagtattaacaggacttaacttacttcctctaatgatttactgctacattatacatttgacaatggtgtacaactttgaatacaaatgttaaaagcagaaaaaggcaaggcaagtccaaacttgcctctgttggatggaaggatgaatgagtggttatattccattaaactaaattacccactttgaaaaacagcattccacatataaattatttaaaaatatatttcgtttttcacaattaaatgtgccactggagcttggcagttgtaagcaagggcctctttctatgtaatttaattcatttattcattcatctttttttcagtcaataataaggaccaacacaagaccctgattttctaaagggataattctataatcattctatatacaaatgttctggataattataactaagtgtcctatcataagagtatctcttatagctttttgaggttatttatattgacacagccagaattatatttcaaattaaccattataacataacttaccttcaagaatcctgacaggcacaatatccacaagagagcaaacagcctataaaaatacaattttagtaatttgcaatattgttcctta

SEQ ID NO: 4614 - DNA, 520 bp, Homo sapiens
ttttttaatctttttttcaaactttattacttaatgaaacagtttctatatactgcttccaattactttaatccttttttctcgttaaattttttttgttgttcttagttgagctgagatacttttaattactttttattaactgcttccagaaaccgtaacaggtgcaggaatagattgatgatatccaagtagaggctgatggcagctaatacgtactcttcaggtgacagtttatgcatcagtgagtgtgtgtcatagatgatgaaattccacagaaaagaagggctcctgcagcggctaagaccaactccattatctcactataaaaaaaaaacttcaagaatcctgacaggcacaatatccacaaaagagcaaacagcctataaaaatacaattttagtaatttgcaatattgttccttacaaaaaaactttgtaaacccattcaacactttctgaaaaaaacatccatctggattttttgctgaagaataactaaaatgtaagaatttgtaaac

SEQ ID NO: 4615 - DNA, 324 bp, Homo sapiens
ttggcccttcatggagcttctgttctcttcacagggttcctgaaggggccaagcgctttgatggctcttcacctgctggaggatgctcttgagcgtgctgtaaagccagcacttccctgccactcctctgctcgattatgcactggaagtagagaagattaccacctcgaagaagccaaatcttatcctgaatgtagatggtctcatcggagtcgcatttgtagacatgcttagaaactgtgggtcctttactcgggaggaagctgatgaatatattgacattggagccctcaatggcatctttgtgctgggaaggagtatggg

SEQ ID NO: 4616 - DNA, 467 bp, Homo sapiens
gcacagagagaaagagagatagcaaatgtggcataatgttaactgctgaatctaagtaaagagtctatggatttttattacagaatttctgcaacatttatgagggcttgaaatttttcaagataaaagctgggaatgatgccttcaactgtgagattattagtaagtggacctgtgatgtgatattcatcaaggggaattacctcttgatcagttgttcctgccctctccacactgaccaccaggttaaatgcaaaccagggtagcataacatgttaactctcagcattagcatccccacttctgacagctggagtggccaggagagcagaagaggtctaccagctggctgcccaggtttaccctgctgacctctggtccaagcattgctgcagggtccgtgatggtagacataacctcgttgattaattccatcggaatatcccccataactcggggtttcttgg

SEQ ID NO: 4617 - DNA, 365 bp, Homo sapiens
  misc_feature (1)...(365): n = A,T,C or G
gggcagctggtgggagaaaacgttctgtaggccaaccagccacatcaggatcttcttgtttggtttctggttgagggaattgccaaccacgtgaaattcaattacacccctgcgctcttccaaccttgccgcctcatccctggccgagtgtgctgacagaaaattggtctgagatgcaagagacaggaaaaaattacacagagctattctctcaagacagtggggatgggacacatccaagcttctcatctttgttctaataaggatacacatttgtgggattttcagagtcctaaatacacatgtgtgccacacatacacacaggagacacatacacatacaagttttggaaggncaggccgga

SEQ ID NO: 4618 - DNA, 325 bp, Homo sapiens
  misc_feature (1)...(325): n = A,T,C or G
ttaaagtcaacgcaaaaatcaaacccagagncccgnaggcnccngaggccaaacagcaaaattaaggcaggactctcatgtacaaatgtccgtacagactcaaagtataaaaaaactgttgaagtcactgtagttaagagaacctgcagagaaagaatgctgtagacttttctcagaaaggccattcggatgtgcacgntggcggaggccacgctgctgccatagttgaagtcgtcctcgatcgaggagcgagggtaccggggntcggggtcatccatgatggcaacagctacccntacggtcncggtccccncgtgcncgaatc

SEQ ID NO: 4619 - DNA, 446 bp, Homo sapiens
ccaaaagtgctaattattacatttacaagtctcttcaatacatcatgtccaattctttgtaaaaaactaaaccaccttgctttaggcacactgcttggtgagtttctaagaagcagaggggaaaaaaaatcacttgtcaattaatccagcttccttaattttactgaagaagaatttctccaggatattggcacatttgtagtattcactctcaggggggttgtactctttgcaattggtaaagactcgctgtaagtctgccatgaataatttcttagacacgtagtacctattcttgaggcgttcactcatggttttcagatccatggggaaccttataaccttcataatatcctggaagcttctgttctcttcacaaggttccatgaagggccaagcgctttgatggctcttcacctgctggaaggatgctccttgagcgtgct

SEQ ID NO: 4620 - DNA, 614 bp, Homo sapiens
cggcacgaggtgaaattatgacagctgatttgtcctggatattggtcttgcactgaatgcgccaaacactgatcatggctgtaaaaggccctttgcagggtcacatggacttgggcccttatctgcagacttgaattatggatttttttttccttcccttgcagggaagaccactgggatccccatccatgtctttggcacagagactcacatgacggccattgtgggcatggccctgggcaccggcatccccaaccagccacccacagcggcccacactgcaaacttcctcctcaacggcagcgggagcacatcggtaggttccagcctccccaaaccttacaggaaggaaccatctcatcttttccactaggatacagtcttcttcctctgttccctgggggcatagaggaaatacagcgggagttagtgcatggttggtttgtggatctctgccaatttttttcctgtcctgattaaagtagtataatggaaggacaaaggattttaaaattggatccaagttcaaattgtggccgggcatggtggctcatgcctataatcccagcactttgggaggccgaggctggcggatcacctcagctcaggggtcg

SEQ ID NO: 4621 - DNA, 445 bp, Homo sapiens
  misc_feature (1)...(445): n = A,T,C or G
aactttattacttaatgaaacagtttctatatactgcttncaattactttaatccttttttctcgttaaatttttnntgttgttcttcagttgagctgagatacttttaattactttttattaactgcttccagaaaccgtaacaggtgcaggaatagattgatgatatccaagtagaggctgatggcagctaatacgtactcttcaggtgacagtttatgcatcagtgagtgtgtgtcataggatgatgaatccacaggaaaaggaggggctcctgcagcgggctagggcccaactccnatttatctcacttattaaaanaaaaccttcaggaatccctggcaggggcaccaatatccccnaaagggggcaacagccctgctcccaatttgcctcgtgcccggattcctggcggcccggggggggtcccctnggttctgggggc

SEQ ID NO: 4622 - DNA, 333 bp, Homo sapiens
  misc_feature (1)...(333): n = A,T,C or G
cacantgtctgggtgaagtttccaaagaaagcagagggnaaaaaaaatcacttgtcaaattaaatcccagcncccttaatttaactgaaagaagaattcnccccaggatattggcacatttgtagtattcactcctcaggggggttgtactctttgcaattggtaaagactcgctgtaagtctgccatgaataatttcttagacacgtagtacctattcttgaggcgttcactcatggttttcagatccatggggaacattataacttcataatatcctggagcttctgttctcttcacaggttccatgaagggccaagcgctttgatggctc

SEQ ID NO: 4623 - DNA, 424 bp, Homo sapiens
ccggaatttgtggatatattttaaaacaactgcaccagggcgtactttctaagtcatctcttactgctgagcgaacctctctgggcttattttgtgcccagtcttttcctttgcaagttaaatagctccaactccttccctctttcttctcttctgttccatttgctaccttcccctgtccattattgctggggcatctctggacccttactggccatccacatccccccaaaatccagtgtacccagtacaagtgtgcttcctaaccctgtacacacttccccaggcctcctcctgatcctgtatcctgatactccctgctctcaacaggtacccgggctccacattcatggatcatgtgttacgctatcaggacactccaggagtcaaaatgattgtggttcttggagaggtgagttacttt

SEQ ID NO: 4624 - DNA, 354 bp, Homo sapiens
  misc_feature (1)...(354): n = A,T,C or G
tttaatcattgtttcaaactttattacttaatgaaacagtttctatatactgcttccaattactttaatccttttttctcgttaaattttttttgttgttcttcagttgagctgagatacttttaattactttttattaactgcttccagaaaccgtaacaggtgcaggaatagatntgatgatatncaagtagaggctgatggcagctaatacgtactctttagtggacagttatccttacagaaatgggtgtgtattagattgatgaatccacagaaaaaaaaggctcctgcagcggcttagaccaacctccattttcttcctcttataaaaaaaaaccctgggggggaaaa

SEQ ID NO: 4625 - DNA, 310 bp, Homo sapiens
  misc_feature (1)...(310): n = A,T,C or G
gagagagagagagagagagagagagagagagagagagagagagagagagagagagagagagagagagagagagagagagagagagaggtgtgttntatgtcagggggatggggccattnnatccttagccattntcacaaaatatgtggagtagtaacttaatatgtaaagttgtaacatacatacatttaaaatggaaatncagaaagctgtgaaatgtcttgtgtcttatgttctctgtatttatgcagctgatttgtctctctntaactcaagtgtgggtccaaggactcctaactactttgcatct

SEQ ID NO: 4626 - DNA, 162 bp, Homo sapiens
gcacgaggtttaaataaactatatagtaacaatgaaaatacagagaagagactgaggtggcagctgcccagaatctttgtggattaccatagtctggtttaaataaactatatagtaacaatgaaaaaaaaaaaaaaaaaaaaaaaaaaaaaaaaaaaaaaa

SEQ ID NO: 4627 - DNA, 239 bp, Homo sapiens
gaaatgtaatgtagtctattttactttgaaaggattcctttatttactttgaaaggattcctttttcaagaaatagctttggagaaaacaaacaaagaaaataaccaaaataaactgtccctaactccttttccttgagtattgaattttctgaaggaaaccctccctgaagaatgtttatatatatatatatatatatatatatatatatatatatatatatatatatatatatatat

SEQ ID NO: 4628 - DNA, 516 bp, Homo sapiens
atgggttttcacagtgctttcccatacaatgtctggaatctatagataacataacctgttaggtcaggggtcgatctttaactacccaggccccagggtgtggccgcctgggctgtcctgccctgtggatttcatttccgcccttttaagtttttacctcctttcctttggaggcagaaagtggggataagacaatatgaggggtggtctcttcccttattgcaatgctatgaaagcaatacacattcagtagaaaccgttcgaatgcccatacagccattctgttttttactcttactgcattattcaatagatggcatgaaatatttaagactttattatgaaaataggaccttgtattaggatggttttgcatcaacagtagggcttaatgttaaggagtgcctcagggacatttcaagggtagggctaagctatggatgttaggtagggttagggtgtattaaaatgcactgggaatttaacagtattttcaacttacagtgggtttatcag

SEQ ID NO: 4629 - DNA, 2885 bp, Homo sapiens
ggatccattttcaatgttatgtttggcacccttaacatcttagagaaacaaaaaaggttatgaaaatagaataaataacaatgtaggtaataagcaagtatttttgtctaaatgaacactagaccatgagtcataaagctaagcttggtccagattcagcattaactagatgtttgatgttgaactttatttaatgtcactggccctggtatgctttctacatcactgtatttaacgcagaacaggtgagacccaaactggggcttagcccctcaagggttcttggctttgttcatgaaagagttcaggggcaagttggaggtagaagaaaacagctttattgaagaggcggtgttacagctctggcatttataactctgtgactgctcctgcagggcaggctaacccatatgcagagagtagcagcttacggcggttttgcagtcatatttatacccacttttaactacatgcagattaagggatggtttatgcggaaatttcaagggaagtggtagtaacttttgggtcatctggtcattgccctggaaagaggcagtaactcctgggtgttgttatagcaatggtaaactgacatggcacactagggggctggtcttatggaagctgctttccattggccctgttttatctagttctcaatttggtctggtgttcaagccctgcctctggagtctagtcctgcctcctacctcatattcaccttgttaagtacattatcttcttacggaaatgcattatcattccatttcttttgattttttttcttttggaatatcagtaaatttcacagaaatattaaaattgtagaatcattgaataattagaacaaggattctaaacaagtttctttcctcctgaaatctctaccaaacaccttcaaacaatgttacaaagcttttaaagaagtatatgaaatccaatgaactaatgtttcctagttagagaacttccatttttttaagattacacaggcatgcacattttcactgacaattgaaatttatttgcctttacatgacacctaagttgttcctattaataactaagatacccaaatataatttagaaatacaaaaaaagaggatgggtgccggtcgtgacgcctgtaatcccagcactttgggaggcagaagtgggcggatcacctgaggtcgggagttcgagaccagcctgaccaacatagagaatccccgtctccactaaaaatacaaaattagccatacatggtgatgcatgcctgtaatcccagctactctgtaggctgaggcaggagaatcacttgaacccgggaggcacaggttacagtgagccgagatcgcacccttgtactccagcctgggcaacaaagagtgaaacttcatctcaaaaaaaaagaaaaaaaaagaaagagagaaagaaatacaagaaaaagaaaaagcaatttggagaaaattttaaaaagcaaatcattttaaaagacaaactacaaagtactgtgtgagctaagccattcataatgttctcatggagctaatgggaaacaaatctgttctttcaaaataattgtaaaatttctgtgtaagaatgaatggaaaaggtcatccaaaaactacttgactacatatacctatggatctctatctaagtgctgaaaaatgaatttttttattcatttggttatgtagcatttgttcattctaattttgttttgttccctgtcatatctctggtacctagaataatccctaccacagagtaggtcttccattactcttatgcttttaaatctcccctcacctcattgtaaatgacttttgatttctcttttatgccctttttatacacctttcccttatatctccatttattcctgaagcttcatgggattcagccattgaggtcacttgggtttagatataccaaaagtctgtgatttctctgtttgcatatatgcacatttgttgttatccttacccttttctatcagttccttaccataacatacacttaattcttggaaattcactcatgtcttacaaagatggcaaattcacacttctgctgtgtatgacacaccattaactgcacaaggacactgtgtatttgctacgttaatatttactgatgagttaatgtaataatgacccatccgcttctgctgcctgtgaggtactttctatctatagggatggaaattaatgacagaggctctctgagctgcctgatgtcagagctgagaaaggtgtgaggggtatataagagctggattactagttagcaaatgagggggtaaatattccagtggatacaagcttggactcttttcttgaagctttctttctatcagaagcatttgctgatattgctgacattcaaacattaaaaggtaaagaatttcctatttctgggaaagttttatttatttagagaaatgcacacttggtgttaaattcatggtttatttcaaagaaaggctaaagggagaatgtattacaatataaatgttcagattgcttagagaaggaaattgggaaagtaaaaatctcgaaattacttgaaaagtggacaatattaagggactgtatcaataaaaattttgatccttgtaaattacgttttaaaaagatgtttcttttaaaaactaagctctaatttaaaattacatcaattagaactgtaagaaatctcttgatttcagtgctggattattctttgcagaaaatttgagaagcaatgggcatcctgaagctgcaagtatttctcattgtgctctctgttgcattgaaccatctgaaagctacacccattgaaaggttggtaacttaaaatcctgtttctttgtaacttttgtaaagtgtgagaaaattagaattaaatactgt

SEQ ID NO: 4630 - DNA, 3153 bp, Homo sapiens
ttttcatcaatacaagatatttgatgtcacatggctggatccagctaaaattctaaggctctaacttttcacatttgttccatgtgttccatgttaccagtcatcaggtggaaaagcggaaatgcaacactgccacatgtgcaacgcagcgcctggcaaattttttagttcattcctgcaacaactttggtgccattctctcatctaccaacgtgggatccaatacatatggcaagaggaatgcagtagaggttttaaagagagagccactgaattacttgcccctttagaggacaattgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcatttttgggacctatatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactgaaaatacagaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaaaaaaaaaaaaaaaaaaaaaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccgggcgccctgcgtcgccaagctcggctttgagatcttcctcagctccttccagggcttcctggtcagcgtcctctactgcttcatcaacaaggaggtaggcagagacccggccgccgcccccgccctctggcgcaggcggggtacggcgccgcctctgagcgccatcgtctcacaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtcctgcccttctggagatgacaactgagtggggaaaacagaccgtgaacacaaaacatcaagttccacacacgctatggaatggttatgaagggaagcgagaaggggg

SEQ ID NO: 4631 - DNA, 2102 bp, Homo sapiens
gagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagcccagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagaccactcaacttgtacttttaaaaaaatagaaaaaatagcatttcaatctaagtggaaatttgactcattgacttacatttctaagttaaaatttccctttatgaagtgtgccttaggttaccaaattgtagaggctttcgttggtggtggtaattggtagcggtagtgagtgtatagaggcagggaaatatatttataataaattctatgtcatgaattacaattgaaataaatagtgaatatacaaatttatatttgtgatgctcaattgttggtccttctttcaaagtggcctcaaacccatatttcaaattgaataaggtacaattaaattataatctctcaaacttatttgaaaaatttcccacaatagtctacagttttattgcatatcacacctatatatgatataaata

SEQ ID NO: 4632 - DNA, 2025 bp, Homo sapiens
ggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggttggggagagacagagaagtgggcaggggcacccaagttgggatttcatttcaggtgcattggagattcttaggagtgtctcttgggggtaatattttattttttaaaaaatgaggat

SEQ ID NO: 4633 - DNA, 1481 bp, Homo sapiens
tgtcaaaaaatctcagccatctagggtgtttgcaaccaaacactgagttacttatgtgaaaaattgttttccttttggggtttttcaatccaattacaagaatatttgatgtcacatggctggatccagctaaaattctaaggctctaacttttcacactttgttccatgttaccagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataaagattattctttgttaacaaattagacattctagcaaagt

SEQ ID NO: 4634 - DNA, 776 bp, Homo sapiens
gaattcccttatgacatttcttgcataacactcctgattcaattatctcaaggaacttaaagactaagtaatgctgctttattcttattggaaagatgtagaaataattatttttaaatttcttcatatttcagattacatataaattttaccttctaaattctttttatatattaaaaataaattcttcaagatttttaaaaatgtaagacaaagacactgttattttgattatatgtaatatattctgaatttccaaaggaagacttttaaatgagaaatgcaacattgactgtaatgaaagatgttgtatgattttcaattgttatttcaaggtgtcaaaaaaaaatctcagccaacttttcacatttgttccatgttaccagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatg

SEQ ID NO: 4635 - DNA, 428 bp, Homo sapiens
gggctttgcacatctccaggtcagacctatcctaatatctacatctacatttccagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaaa

SEQ ID NO: 4636 - DNA, 412 bp, Homo sapiens
  misc_feature (1)...(412): n = A,T,C or G
cttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagacaggaatggatacttccagngttgncaagaaatatactcttggaacttaggggggnaacgccagaacatgaagcaggaaaaaaatcaaangtcatcaggtggaaaagcggaaatgcaacactgccacatgtgcaacgcagcggctggcaaattttttaggttcactccagnaaacaacttgggtggcattctctcatctaccaacgtgggatccaatacatatnggaaagaggaatgcaggc

SEQ ID NO: 4637 - DNA, 463 bp, Homo sapiens
  misc_feature (1)...(463): n = A,T,C or G
atcttacagaaatttctattcagtcctacttagtaacaaagagcatttgattgtgggtaacgttgacatactcaactattctaatgcacttaatcttcaaaatattttcttcagtaacatctttactgagggaggaaaaagttaacggttcttcatacacacacacacacacacacacacacacacacacacacacactagtgcccacttatccacaggggatacattaccagaccccttccctcccactggatgcttgaaaccacggatagcacctaacccaattttcatcaatttgaacatgtttctgttcatgtctcccacttcacaaatgttaacgccttttcccatctttaactgaggcaccttgaacatggcacctgtgggcttttaattttgcgggttgggggtgtggacagttaaaattggctggatttntttgtccctcacattttcggggtgg

SEQ ID NO: 4638 - DNA, 504 bp, Homo sapiens
  misc_feature (1)...(504): n = A,T,C or G
caaaaataaccctcanctaagggnaataagccttgcggccgccttaaatnaaaagaccacttgggtcaggatcccccaagtaattttatgagaaagctcagaaaatattcagttttcatagtcccatgattacatactcctgttcatgagtactagtaaaaggttgattatgccagagaatttctataataagcattagcgacgaacccaataccctgtcataattcagtaaggtttatatattttggcaaaatcaataaattaggcattcagcaagaggcaatgtagaggcagtcattcttgcagtgtaaagatctttttggccaggcacggtggctcatgcctgtaatcccagcactttgggaggctgaggtggaccgattacttgagctcacaagttcgagaccagcctggaccaacatggtgaaaccccatctctaccaaaaaaaaaaaaaaaaaaggtcnttattaattcttccagttcccgtgccgaattcctgggcn

SEQ ID NO: 4639 - DNA, 541 bp, Homo sapiens
  misc_feature (1)...(541): n = A,T,C or G
ctgtgtctctgtcctagatgaatatctttcccaaatgttatctgtatttattaataatattaaatccataatttaaagaatggagttattcattattaggatagttatttttatatgatttaggtaatctggaacacgggctgggaaatttttttccatctcctcctcctcccttcctcgcattctcaatgttaatctgcagttcttttgtataatttttttgttgttgctgccgcccaagatggagtgcagtgagccgagatcctgcaactgcactgcagcctggataacagagcgagatcagtctaaacaaacaaccaaacaaaaaaatatatatatatatacactcacacacaaacacaaatgatctatttaaaaaatacattttatactgtattcttggtgagattttagtctcataatttctgcactgacagaaggggaaaantaatntggactacatttnttccagttcaatacagtttaanccagantaacangacagttaaaagaatttatttantactgatccgatccctcc

SEQ ID NO: 4640 - DNA, 1029 bp, Homo sapiens
ctgaagtgggaggactgcttaaacccaggagttcaagaccagcctgaacaaaatagggagacccccatctctacaaaaataattttaaaaagctgggcatggtggcatatacctgtggttccaggtacctggagggctgacgtaggaggattgcctgagcccagcaggccaaagctacagtgagctgtgattgtgccactgcactccagcctgggcgaaggagagcaagactctgtctcaaaaataaatacataaaatacagcgtccaaaagtgtgtcatcttctttctcttcacaattttactaataagggggtaaaatgcctgtgagtctattcattatggaaaataaaaaagaaacaaccatttaaggctgaggcattttggttttctgctggcttttagattattaactgcattaagcccctcactacaacttcaccagtatcctagaaacaatttgggtttccttttaggcagggacaggaagtattcaaaggacagacatatggacagagttaggcccttcagggttgaagtctgtggtttcttgtgtctcaagactcaatgtcttgagaagttggtggaccctgtcctccatccaagaagtgctgccaaggaaaccaggggacctagcaaagagtcaggagaaaatggccaaaggaattctgacattccatacctgaatgaactgttttcgtgagtgctttgatcaccctatcccctatcaaggcgctgaacaggtggcccgcaggaaatctgctgtcgcaagaggagggctttgacttacttcccctaattgttgagtaaaaagtgattctcttaatttctgtattctgtttttcatatcaccagtagaagggtcctgtggatctaaatagagcacattttaaggctacagagtagtagaaattgatgtttagacaaggcagcttgttcaaaatctgaaaggcacacccagaagctttctctaaacattttggctcccattaaaaaaaaaaaaaaaacaaaaaacaaaaaaaaaaacaaaa

SEQ ID NO: 4641 - DNA, 551 bp, Homo sapiens
cgttgcaatgagccgagatcacgctgttgcactccagcctgggcgacagagtgagactccatctcaaataaagaaagaaagaaggaaggaaagaaggaaggaaggaagagaaagagaaaggaaggaaggaaggaaggaaggaaggaaggaaggaaggaaggacacgaaagcaagcaagcaggcagcatccgtttagtgaccgtgctgaccatcgccagcacttgaaccagcctgggttgggggttatgattactggacttctgtgctgcccagttccaccacacccctactgtgcctttccttttcttcaggttcctgagctccctgtatatatcctagaatggttaaaaatgttaaactgtcaataccaggtgttattgaagatgcagagcaactggaacactcagacactgcttgtgggaatgtaaataggaacaaacacttcgaaaattctttgtcagtgttgactgtaaatatacccaatgacagtaattctactctgaaatatacgcccaagagtaaatacactaaaaaatgatataaaaaaaaaa

SEQ ID NO: 4642 - DNA, 551 bp, Homo sapiens
  misc_feature (1)...(551): n = A,T,C or G
aaggaaggaaggacacganagcaagcaagcaggcagcacctatcagaataagtcatccatgtgggaagggggtgaggggctactctctggcattaactttccatttctcccccaaaagctcagagcctgccctgtcctcagacactgaggtggagagagctgaactcctccaggctctcccttggggatttgcatccgtttagtgaccgtgctgaccatcgccagcacttgaaccagcctgggttgggggttatgattactggacttctgtgctgcccagttccaccacacccctactgtgcctttccttttcttcaggttcctgagctccctgtatatatcctagaatggttaaaaatgttaaactgtcaataccaggtgttattgaagatgcagagcaactggaacactcagacactgcttgtgggaatgtaaataggaacaaacacttcgaaaattctttgtcagtgttgactgtaaatatacccaatgacagtaattctactctgaaatatacgcccaagagtaaatacactaaaaaatgataaaaa

SEQ ID NO: 4643 - DNA, 21327 bp, Homo sapiens
aggtcctccataaacaggattctgcctcagacccgtgtccctccccttttctctctccacaggaactcagcccctggcaggcttgtggtgcagatagtgaatggtcttgcagtggcgggatttgtccacctgtgtgtccctgtgtttgagtttcttctgcttgagtctgaacttcaggctggtggccacataacccaacactctcactttacggatgagaaaacagaagcccagagagggccagggacttgtccaggttccttcagccagtccatgccggagctgtactagacaccctcctctctgtgcccagagcgatggccacaacacccctttctgtctgcttgaaaacccctcttcattcttgctgatctgtactcatctttcagtctctgcctctttagcaaccagagcctacgaagaggtgaccaggctctggtcaccccccagagcagagaaactgggggtgtaggggtgggaactgaaggggaggggcatggcaggggctgagaatgcggctgttctgcctgggggcctgagccaggctgcctacagaggagccagtatgcccagacattagagctttgtgagttgaagagcttggtgtggggaatggttgttttgttgagctacattgtttcaggttgactgaatgtcagtgtcttagtgtccaggagccagctctttagaaccagccagggtcttggggagaatgtggctggggcatcctagtctggatcaaggaggggggggggctgtccgtgccccgtgagtgctgagcagttccctgtggagaaaactgcagaggaggagtgagtcctagcgtggataccaagagagacgagaggagcaggcgcccttgcaccttggggccagagcagaagggcctggccagagtggaggatggacagaggcaggacagggacctctggaggctggtgccttcctgccagggcactgggagccctgaggacagagcgatcaaaccttcatccacaaaggaagagtcaggagaaccatggggaccaggagggccccgagaggccttgggggctggccaggcgggtggggtgggccagactcacagctgtccagatgtgggtaagagataactctgtttactgggcacccagtgggagcggggtggggggtgtgggaaggggctcccagggccagtggggcgggcagattaggaggcgggggcatgagtcaggggtttgcgagctgcccctggggcgctggtgctgtcagaacgagtgggaacgtagctggtcgcagagggcaccagcggctgcaggacttcaccaagggaccctgaggctcgtgagcaggtgggcagggcagggaggggctggggatggtccttcggtgcctcccctgagggcttctacaggtgcccagcctgaatctatgcccaggtgggccaggctcctgacctccaagggggtgcaggtgggtggggtgagaatgttaccatgcatatgttgcccctaagggaacaggcccattggcacctgaaaagaggagggtggcaggtggtcaatggcagcagatggtatgtgtggctccggtgcgtgtgttgcggggggtatctgatcccctccaggtatgggcccttgtcagcttgttggatcccacagggtcaggtcttgtccaccccagactccttccttcctaatggggtcctcagaccaccccctctcccacctaggaggcaggatgtcagctgacacagtatcccctttgggacacttccaggggtctacctggggcacctggctccacccccagcgtgtcagtattggagggaactgcagagcctcctaccacatgagaatctcaaaacacttagctcaggctaattccatgggaactgagggcaaatcagaggggaaatgaagatggcaagtctgactgtaaccccagcagcaagggataatgacagcaaacattttcatagcgctccttatatgctaggcactgttctaagccccttacaaatgtaaatttccttaatgcttacaacaggtctatgagatgggcatcattatcatcacccccattttacagatgagaaaactgaggcacagagagttgaagtcacacgccgttagtaaatggcagggctgggctttgaatccaggcagtccgactgcagagtccgtagatctttaacaactaactctaaaccagctaacagttgttttgttggaggcaacttagcatagtgcttagggatgtggctggagtcaggtagtccaggctgtaacctggctctgatacctacctgctgggtggctgaagcaggtaaatgtctctgaacctcagctttcgcatctgtagaatggattaatgacattactcttcttcctcttagaatccccaaaccacttcacagaatgctttggggattctaagagttaaggcagtacagttctttgtgcagttcgggctgattacacaaaggtggtgccataccactaggaagttgtccctgtcatctggtcaatcccctctcccgccgtgtcttcccagctgtgctataccttctaggctcagatgtcccgctcacccttatctggcctggccctggcagctggctagctccgatgtttggtgcacttccaaaacttggggcagcgatctgggtccaggcccttatcagtgctaggcagcacaaggcctgcagctggggggcggcctggctggcgggtggcaatctgggtcatgggtgctccctgtaagtctccaactgagctcaaggcacctctgttttcccctcttctctctcactgatgtctcagaaccctggcaggaaggcactcccattgtacagatggggtgactgaggcctacaggctggaagctgcccaaggcccttcagccagtcagtggcagagaggcagcctggacctctggattctgcagctctgagggcccctctgaccattccactcctcagataggcaaccaaggccacagtcccagccccatgggtgggacttttagtacctaaggcttagacaccctggaggccttagcatctgaggcctaagaaagtgcatgggcaagtccagagaaggaagaaagtgaataaagatggaagagaaagatggaagagaaagaggaactttgggagaagcagagagggaggaggaaaaagagagagaagaggtgggtcatcagggtcctcaggagcaaagccaagccctgcagtagggactacctcgtcctcaggtccaggacccctcccccgcaccccatcacttgccccacctgccaaggcaggggtctctcccattctccagtctggtgagatccagtaatcccctccctacccccaggactgcagggtcacccattcctcagaaagaaggctgtttgcacatccttttttttcttttttttttttttttgagacggagtctcgctctgttgcccaggctggagtgcagtggcgcaatctcggttcactgcaacctctgccccctggttcaagggattctcctgcctcagcttcctgagtagctgggattacaggcatgcgccaccacgcctggctaatttttgtattttcagtagagatggggtttcaccatgttggccaggctccctgccccatgccctcacgtggcattttcccaccttgctcagcccacctgttcagctccacccaggcatgcctcacatctggactcccagcccttcacatctcaccagtgcttggctgggcacggtggctcacacctgtaatcccagcactttgggaggccgaggtgggtggatcacgaggtcaggagattgagaccatcctggctaacacagtgaaaccccgtctctactaaaaaaatacaaaaaattagctgggcgtggtggcgggcgcctgtagtcccagctactcgggaggctgaggcaggagaatggcgtgaacccaggaggcggagcttgcagtgagccaagatcgctccactgcactccagactgggagagagagcaagactgtgtctcaaaaacaagaaaaactcacctgtgtttttacgtagcgccagtgacccctctccggtgactccacccccgagtgctgcaaacgcgtcctgctcttcttcctgccatacagatccttggcactcagcactttcggccctgggtccatgtcacctcggaagcactgaggctgccctgtgttcccagtttgcctccctgtgggaggctaggagcttcccccagagtagagacgggccttgttcagctcagcaccccctcccaccagcccccagtgctcagcaccccctcccaccagcccccagtgatcagcaggccctccccacagcccccagtgctcggcaccccctcccacagcccccagtgctcagcaccccctccccacagcccccagtgctcggcaccccctccccacagcctccagtgctcaacacaatgccaggcacagagtgggaacctttgttgaaccgacccaattgcctgtcacctcaatgccctgtgctgtagtggggcgaggagggaaaagaggcacctccacacccagtctgggccaccttaggtgacccctgtcctccccttggacctgccctcacattcctggggaaggcacaccttcctctctgctagggacacaactgagaaaactgagaccccgagctcagaggcctcttggctggggcctagtcatcctggctccccagtctcagagccccaaccccgcaatagggagccattcttacaatcattcagtaaatgtttattgagcacctactacgtgacagccactctgctaggagtagtgaatttcgtggggatgggacatacagggtcttcgcactcaggtagtttcccttccaaaagcattgtcagataatatgaacacaaatcaatcaagaaaccacgtattggtttttttgttttgttttgttttccttactaaagagtctcactctgtcacccaggctggagtgcagtggtgccatcttggctcactgcaacctctgcctcccagggcttaggcaatcctcccacctcagcctctcaagtagctgggactacaggtatacgtcaccacacccagctaatttttgtatttttgtagacatgtggtttcactatgttgcccagttggtctcggactcctgagctcaagcaatctgcctgcctcagcctcccaaaatgttaggattacaggtgtgagccaccacgcccaaccaagaaaccattaaaaattagtcaggcatggtggtgtgtgctagctactctggaggctgaggtgggaggttcacttaagtctaggagtttgagactgatgtgagctgtaatcatgccactgcattctagcctggataacacagggagacccgctctcaaaaaaataaaaaagaagaaagaaatcagcagcccacactgagatagtgagaccctgttctacacacagttttttttttttaaattacctgggcactgtggcatgcctataattccagttactcaggaggctgggccaggaggatccctggggtcccaggagttcaaggctgcagtgaactatgatcatgccactgcactctaagcctgggtgacagagtgagactctgtctcaaaaaggaagagagagagagaggaaggaaggaaggaagcagggatggaggaaggaaggaaggaaggaaggaaggaaggaaggaaggaaggggagggaggggagggagggaaaagaaaggagaacatgacagattgggtcaaggtggtggccagggagggcctctgaagaggagacatttgggccgagatgtgagaaggtctgaggtattggggggagggtgtccgggatatggacagctggatgtgcaaaggccctgggacaggaaagggcttagtgagttctaggaaccacaggaggccaataggctaggtggggagagagcgagagagacggagtgcaagatggggtcagggagagaagtaggaccactcgtccagactgcggaccactcccaaggatgctgcagcccatccggtgggcagcagctatttctgagagaagagcatgtgtttagagccctcaggggagctaagcccccctgaagaagagaccagcaggtcccctggtattagctgagtcccagggatgggcaagaaaagaagccaggtgaagactagagaatgaaggagggagatggacctgagggtgacctgcccatcttccccaaacatccttcgctggtgccagccagacttacctcttccctgcactgcccctctctcccagcccctgctcacctaccctcacacctgcaaatccagctcgttctccctttccctccacacttccttcctctggccctaccacctccaacacgtggatcccctccactgacatgtggccccctctggaggaggaccaggagaccctgggatgccctgtgccccactcagcctgtgccctctgctgcagggacccgcggtgcgggttatgctgggggctcagatcaccgtagacaactggacactcaggaccacgccatggaggagctgcaggtgggtgttccctggcatcagcagtgctcccacctggaggctctggggacctggtcctagactcctatcttcgttgggggtggaagagcccctcacagcccagcctcagcggccacttcccacaggatgattatgaagacatgatggaggagaatctggagcaggaggaatatgaagacccagacatccccgagtcccagatggaggagccggcaggtgagcccctctccctccctcagctgggatgagctgctgagccctagacagggacaggaggggcacttgtcctctccccttctccacagtcctcctcccaagcaccacgggccgttctcccctcaattctggctgattgaaggataaacagagctttgtttgaaatgatcacaggaggtggctgggagagcaggggcagtcacccatccagtgcccctgcaatgtgagaagggcgggcagccagtttgggacaagggcgtgagcccacatgccatctgtgcccatccaatgccagcttccaggccagaaaatgggcttgttcttggggaaagaggtcctgagaaatgaggggcttgtggggaccctcctagatagaaagacaccaggaaccaccctgccttccctggcctgtccaaggtcttaggtggggagccccaggcaggacctgtttactgtcaacaggacttaagtgctggagattgggattaaagttaagaggcccctcttggaaatgagggctgggggtgggaggggtgggaatataaggggctgacccaccctggtgcctcagctcagtgagacactgtgctgacgggctcattgaggcaggtgggaggagagaagggagtctggtctcagaggtggcaggggagggaggaggtcctaggaggatcctgaaaattgccactcagggctctgccgtcaccttggagaggtcccttcacttcatcactgcggaggggctaggcctccctaggtggctgaatcccgggtgtcctcgacaaggctcagatagggacccaagctaggcccagcacacaagtgtggggagcctcattctgctgagtggccagtgtgggatgcggcaccagagacccagcccagggcactgggaaggagggcatctgcccatgcctgggtctctgaggctcacagtggatggtgaagagcctcaggtgggggacggtcaggtcaatactaaccgacctctggttttcagctcacgacaccgaggcaacagccacagactaccacaccacatcacacccgggtacccacaaggtgaggaccccagcctcctccgttctttcccatgctgcctttgggacccaccatttgatcagggaagagaggagcaaggggatagaggcagcttcaggctgggggagaccctgcagcagatagaggagtgaggatcccaggaaacaggtgggagggacgccccactgatggggaggcctgggccctttccaggagcaccctgggcagagataacctgattgacaagggctgagtcccaggcccctcaggcctggctgggctgtccgggcgtcatggggaatccacagaattgaagacttgttctcctctgcccaggcccctcaggtccccactgggcactgaactgtctaagtggttagaaatttggggtggccctcagctatggccctcagctatgcccttggagcaaccacctggcctcagggacatgctaaagcacatccacgaacaatcttagaggctggagactgacccaatgactccaaagtcccctttagctctgcccgccaggcctctgcttcccactcctttccctccccagtggcctctccagcatccctttgggtcagggttctccaaatgccttctgcaatggggtaaaggcctggccaggaagttgggatataagggagtggtgtgagcgtatctacggacccttgagcacaggatccaagcctcacaagcacaagcctctctcgagagcggctgagcacccactatgccctggactatgcctgatgaactaactcaggcgcatggggccacaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtgagcctcctgggcccttctggacctcctgcagatgaggattgttgtggggtgctgttggcccagcctaccagctcactcctccactgcctgcaggtactgtcctcctagacctgcaagagacctccctggctggagtggccaaccaactgctagacaggtttatctttgaagaccagatccggcctcaggaccgagaggagctgctccgggccctgctgcttaaacacaggtgcccctgcctgccagggcctggattccatatccagtgggcccacttccccagcccacttgccccaagttctcccccgggatccaggtggccctaccctcaccaggcaggggcccactttcctccactatggctcccatctctgacaccttgaaaggggaggccatgtcctatgctcagagttgggggctgttggtccccaggagggcagacctgcaaggcccttttctgtagccactcttgatcccgcctcgtcattccagaggccacccacttacatctacaacgtccttggagaggaggctctgattctccttccatcccagggtctctctggtctggtctgggaagtcccagatgtctacccttgatgtctaccccagtcccttgatgttcgcccttgatccctcccaccactgatagctcagcctgaacagcttactcagcccatgtcccctgtacgtcctgcagccacgctggagagctggaggccctggggggtgtgaagcctgcagtcctgacacgctctggggatccttcacagcctctgctcccccaacactcctcactggagacacagctcttctgtgagcaggtgagtcagttacagggtcagggtcagggtcagggtggggcaaggagagagctttctcaaacgcccagcaggggtcctgaaaaaccaaccacaagcaggggaccagaagcactcctgtgcccggggggtgtccaggagagttgggaagcgagaatgggaaggggaggatgctcaggtctcccaggtcagactggcccgaggactcccgtcaccaccctccttcccacagggagatgggggcacagaagggcactcaccatctggaattctggaaaagattcccccggattcagaggccacgttggtgctagtgggtaagaacaggcatctctaccctcagccctccacacccctcgtgtcttggctcagcctgtctttccctcagcctggacccccgcagccccatctcttcagcacacccaccctgggctcctcggcctggcctgatcttctcatcccctaacaggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtaaggaagggccggagagggctgggctggggaagcttgggacctgcatggtggctgaggcctgctctccaacctggcctgggttactttaggttcactggtttgacccattcagcctaatcagctgctgctatcctacctggcgggggcagtcggggcgtgcagtctggccctgctctggcctggtctcgtctggttggctttggcctggcttagtctagtccagctcactatgacctggttccacctggtcaggtcaggcttggtcgggcctagtcagctctagtttcatctagtctgcttaacccaccaggttagctttagttccttctcctttccccacccagggcccccgtctgtctccccagagctctttcttagtggggagagtaggggtgggagcgggcaggaaaagcagttcctggcaatgggagctgctgcctgagggggttctggttcctggaggccctggctgtggactcctgggtcctttccctccgcaggtccgggcagctctgaccctgtctcctgcccctaggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctaggtacctgcccttcccagctgaggctttctgagcccccaccgacccccagacacctcagcgtagcctctgtctggatcacatgttccctctcattgctcctttgccacatcttcagacttcttcgccgccccattcccatcagacaatctcccctacaccctccagtcccctttcccctcacctcctccagctactccctctgaccatgctcttatcctccaccacagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggtcagtgccaatacctgtctccctaactcttgcctctgaccctctggcctctgtctcagccccaacttctgactctgtctgaccctccagacccctgcatcagcctgaccactggacttgctctatgggctcctgggaaatgatctcctgaccttgatcccactgtgacctctacccacaggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcggtagttctgtccttgccccactgaccctgtcatgtcccccgcaccacctgcctgatgcatggtgccttgccccaagaccctttgactgaccggcttcttctgaccaccctgcagttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaaggtgggggcctatggggatgttaatgcacacgggaggttgtgtataagactgagacagtggccgggtgcgagggctcaggcctgtaatctcagaactttgggaggccgaggcaggtggatcacccgagatcaggagttcaagaccagcctgaccaacattgtgaaactccatctctattaaaaatacaaaaatcagccagatgtggtggcatgcatctgtaatcccagctactcaggaggctgaggcaggagaactgcttgaacccgggaggtggaggttgcagtgagccgagattgtgccactacactccagcctgggccaacagagcaagaatccgtctcaaaaaaaaaaaactgagccattgtgtcctcgcacatgtgtctgtgcagcatttgtgtgtctttgctttcacctgtgtacataaccatgtgactgtgcacatgactgtgacaacatatgtgtctgtgtcaacatatgtgtctatgtctgtgtagtcacacatctgcacacaggactgtgcagctgtgttgactgtgaccacatatgtgttggcacctgctgcctgtgcgcagcactcttgctgaggcatgagagggtgacctctgtgtgcagcatgtccagttcatgaccacacatgacgtgagcaatgggtaggtatgggcatgacgactgagcatgtgaaagtacatgcacagtgagagctggggggactctggagcctctgaagtcccccactccctcccctgtgcttgtcctcaagagctgcagggcttgtggatggagtgcccagccaccttggcttggctcccatcatcttaagctctacttgcctttgtacctgcattttatatgggagaagggtgagccctatgtgttgtcccctgattctgttggatggagggtctttctgtgtccaggtcttttaaccccttgttagaaacttccctgacccttgtttcctgacctccagccttctcatgtctcccaggtcctgggtgtacatgtgtgctcgcacacacacccattgccttccatggccctccctgcctaaacctaggctgtcttcattcctgaaaaccaagctgtagaatcccatttatcctctgtttccatgtcaattgaggaagaagatagatggatggatggatgaatagatggataatggatggacggatggatggatggatggatggttggatggatggatgattgatgaatgagtgggtggatgatggacggatgaatggatggataaatgggttgatagatgataggtaggtggatggatgggtagatggataatgaatggaaggatgaataatcaatggatgatcaatggataatggatagatgaatgatggatgggtggataaatggatggatgatgaattaatagatgactggatgaatggatagtagtgctgggtagagttagctggtggtattttccagcccaagccaaagctgggagagaacagaatgccttggttttctgctgcagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaaggtcagcataccctcctcgcctgtccttgccaacactgccctatcccagcccaaagcccccccgctccaaattcctcagtgcccttagcttcccttcgttttcagattcccattcccaattccaacctcccctggccctatccttacctagggtttcactctatgggcaagcccctcccactttcatggcatgcccagcctgagactgctggggaagaagaaaggaggcagagagcagacatagctaggtgcaggacagggcattagatgctgatggatcccctggaagagcagggccccgtgggtgaatatagggcaggaggaaggcaggaggtggggagtgactgggcactgaccactggtcctttcacctgcccccagctgcgtcgggtcatcggggacttcggggtccccatctccatcctgatcatggtcctggtggatttcttcattcaggatacctacacccaggtgacccctcctcccagccctcagaccatgataccccccaggtcctcatttccaccccccagcatgccccttccctagaatagctttccccaacctgaagccagctgggactacctctaccccatccctgcctcctctgggagtcccatgtgcttctcacagccccagaggacccctgtggccaaagcaaggtgctgggccaggttgccaccttcattccttaacccagagcagtaggaagaagtattctttggagccaggcagatctaggcatgaatcccagctctgccatcaaatagctgtgtgatgtggggcaagctacataacctctctgattctctttcctcatctttaaagtggggaacgagcagatggatgtaaagggaattagtgtaatattaggtacagagcaagtgctcaatataagtaagttcccaagtgcctccaacctaactgcccgacccctaggaccctggctcctcctgctcccacccttccccatcctcctgcccttggcattcttacctgctaccccctcccacagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgtgagagacagggtgggggctgggcctgggagggtgggaggcagagacctttccctggcattctcccaggcaggcaagagacccaggactacaaactagtccctgcggtgtgtggccctcccgactagcaggaatagtgaaaagccaggggagttccaggttttgtgggaccagaagttgtataatttggagagctctttttaagaaaaaaaaaacgtggccgggcgccgtggctcacgcccgtaatcccaacagtttgagaggccgaggcgggcagatcacctgaggtcaggagttcgagaccagcttggctaacatggtgaagccctgtttctactaaaaatacaaaaaattaggcgggcatggtggcacgagcctgtaatctcagctacttggggggctgaggcaggagaatcgcttgaaccccggaggcggaggttgcagtgagccgagatctcgccattgcactccaacttgggcaacgagagtgaaactccatctcaaaaaaaaaaaaaaaaaaaaaaaaagcgccaggtgaggtggctcgacgatctgtaatcctagcactttgggaagccaagacggggggatcacgaggtcagtagtttgagaccagcctgactaatatggtgaaaccccgtttctactaaaaatacaaaaattaaccgagtgtggtggcatgtgcccgtagtcccagctacttgggaggctgaagcaggaaaatcacttgaacccgggaggcagaggttgcagtgagccaaaatcgcaccactgcactccagcctgggcgacagagcaagactctaggaaaaaaaagaaaaagaaaaaaaaatgcaaaatgacaactataaaattaggtgctggatcttggagggcctgtacaagcaaagctccctgaagctgaagcttcgttgcctgcgaatcagccttgaatgttgtgaagacatttctgctcttaagagtttggattctcaagatggggcgggagggaggggagcaaggaactcaaagagagaggggcacagaagacaaaactgagctacaaggacaccaagtatggagaaggaaggagggggtggaggaggcaggggagaaccctgcttacccctcaccttcccctacagtaggctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggtgagtgaaagctgggtcgcgtcttcaccatcctcctgcccctcacccccggccccttccccttcccctttctgttcggacccagcacctcctccagcctcccccatcctgcaccacttccccacatctccccagcatcccctactcacacgaggggatcctggaggaaaggccaaggcactgggctgggcgtctgagcagggaggaagggggctccactccgaggccttctccagaccagaccccaccttctgactgtacccaacagaagtccagtgaactgtgggttctagccctgggctgctgctaacccaggatccctccttttatctgggtctcaatttccctgtctgcacagttggagagttcaacagatgtccccagttctcttccagctcagctgctccatgactgatacaaggggcggtgctctagccatagtccagggatgtgggggagaagaaagaagggtcactggggttgatttcagttctggagcagccaagagtcgagctgggttcggtgtgggcagtgcatggttgcagatggagaggtcagggaaaattcttaaaggaggcagttgatggcattctgggctggggtgaggagaaaggtgtgtgtgtttgacctctgtgaccctcattaggttaagggagtgggcttaagtcaggcaggcagggctttgactccttgccagctgtgtggccttaggcaggttgtttacctctctgagcctgtttcctcatctgtaaaattggggtaatacctataaaaaggaccgatagaggccgggggttgtggctcacgcctgtaatcccagcactttgggagactgaggcaggtgggtcaccctgtccaacatggtgaaaccacgtctctactaaaattacaaaatcagctgggcgtggtgtcgcacgctataatcccagctacttgggaggctgaggcaggagaattgcttgaacccaggaggcggaggttgaagtgagctgagattgcaccactgcactccagcctgggcaacagagtgagactccgcctcaaaaaaaaaaaaaaaaaaaaaaaagacccataggaatagctccaggccaggcgtgggatctcaacactttgggagccaaggcaggagaatcacttgagcccagagttcaagactagcctgggcaacatagtgagaccttgtctctactaaaaattaaaaaaaaaaaaaatgatccaggtgtggttgtatgtgcctgtagttccagcaactagggacactgaagcgggaggatcacttgggatcaggaggttaagtctgttgtgagccgagatcacactactgcactctggcttgggtgacagagcgagatcctgtctcaaaaaaaaaaacaaaaaaaaaaaaaaaaaaagaaaagaaaaggaaaaaagaaatggctccatatggtgcctgtgttttattcccagccccagatagggcctgaccccccactggccaggctcgggcaacctgggctgagagtgtgcggctcccccacaggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtacaggacccttttctggctgcccagcctggggtggtagagggtgctggggtgtgataggcactgaccccagcctccgcctgcaggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtgtgagtggctgcctgggcctggggcacaagagctgggagcatgcgaggggcgcgtctcagaactagggcaggcaggacagagtcatgggtaaagtctggggctagggctggtgtccaggttctggcctgctgtgtcctagcatatgatctggagcacggggccttgtttctctgtgtcttcattttgctcacctgtaaagggggaaatgatggcacgactggggagagcgtcaagaggcagacagggtgtgctgtgagtgagctggacccctaagcagcaagtcctgccgtcttccgagtcatttgggacagagtcactcctctaataggattcttccacagggtgactcaggtcactgtggggccgccttggtgaaaaggtcccctgctcaccctctgcaggccctccctgccagggtccacatccccggggttgcctctcactttgacaacgactcatttaggccagtcctagctgctggggagataaaacaggactggtccaaggttcaagacagccagaccctctcctaactccagaggtgcctttcgttgcccggggagggctcttctggccccagggtctctcaccctgtctctctcctgtccctcccctccagctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactcaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggtaagtcccttgacctttccaggcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctggtgaggacaaggtacaggcaaggatgatccagggattgggcctgggactcaggcctcctaagtgtttggttcctccctccaaacactcattagttcactcattcattcattccacaaacatttactgagggccccggaatcagtggactccgaggggactgagacaagccctgccctggggtgggggtggggggcaaggtacagttgattctacatttggatagggagtgggggagggtgggaaggtaggggcgggagagtgagggggtttgtaatttattaattgcgtattttctaagagttttcaacatagtttggcttcacacacaacttcaggcccctcatttgagagccattatcctcaactccatctaaactgaatcttggggagaacccagatctgaccaattggggtaggagacagcaggctctccaagaacatgggccaaatttatttttttataaaacaaaaagataaaaagagttgaaagacgtgaaagtggtgagagatggaggaaacagaatcaggaagtggtagaaaagagaggaggtggctgggcgcagtggctcacgtttgtaatcccagcactttgggaggccaagttgggcggatcatttgaggtcaggagtttgagaccagcctggccaacatggtgaaaccccgttactactaaaaatacaaaaattagctgggtgtctcgtggcaggcacctgtaatcccagctacttagaaggctgaggcaagagaatcacctgaacccaggaggtggaggttgcagtgagccaagattgcaccactgcactccagcctgggcaacagagcaagaccctgtctcaaaaaaaaaaaaaaaaaaaaaaaaaaacggaaggaaacatcagccttgggggccacagactcaacatgtgtgtgtggtggggttccagcccaacatagagtaacattatttgtacctcccaggctagctcagtccatgggaggctctcctgtccctgaaagctgacacccacctttcaccacttcgcccatgctacagttcagtttcctcgtctgtaaaatggggatgataatggtacctaccttgcagtgttgttataaggattaaaggagacagtgcaagaaaaggccttggttggtgaagagcccaacctcggaggggagctgctgggatcctccttatcttgactgggatgtccctgtctccccctccccttgctccttgaacatggccaaggaaagtgaaaaacaaaaattattcactctgctagcacccttccccttgatgcctgggaataggttttgccaataaacgtatctgtgttggagtggctgccttgcctgaattcccgttcccagagtcggggggtcccgggggtcttggctgaactaggtgggcatggtgtgtgtggcacgggcctggcacagggctgcatctatgccagcaaggggagccaggctgaggtgtgaccctgagccctagggtgggaggccagcacccagagagtgggtagggagcaagagatgagattatgctctgagactccttcctctcctgaataagcaagacctgtgggggtgggaggagggactgtaaggggaccttgcccctgctccttatacttgtgagcccccaattccctttt

SEQ ID NO: 4644 - DNA, 3675 bp, Homo sapiens
ggaacgagtgggaacgtagctggtcgcagagggcaccagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgtcctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctggcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactccaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggcaagtcccttgacctttccaggcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctgggtgaaggaaggtacaggcaggatgatccagggattgggctg

SEQ ID NO: 4645 - DNA, 586 bp, Homo sapiens
aaaaacaatttttttttttttttggtagagatgggagtcttgctatgttgcccaggctggtcatgatttcctgatccctagtgatcctcctgcctcagcctcccaaacacaccaccacacctagctaatttttttcttttttcttttgttattattcagctctctttataactggcttatttttattattttttgtagagaaggggtcttgttatgttatccagcctggtcttaaaatgtgactctgttgttttatacaaaacacaatcattttccatttgaaaacaagttgtattttccagcataaaattccagatttatagactatattatagtccttaggacccataatgtgtttccaaaaaatacttgccaatgtctgtactttcagtgatctgtaacctcttggagtagtggagagtttaagcaacttgtccaagtttacctagctaggatgtggtggagctgaaaacctacctttgcctgtccacttcataagccaatgcttctagcccccacattacagtgactattcttccaagatctgggaacggaagatgaatgaatggaagatgaatggtttctc

SEQ ID NO: 4646 - DNA, 552 bp, Homo sapiens
  misc_feature (1)...(552): n = A,T,C or G
ttttaaactatacggtgggtacactggtgttcttttattgttactctttacacacaaagaacagataggtcctgaagggccctttgatagtctcgcagcactgatgagtgatcagctctcccctctttctctggaactcggtagcttcatgttggcacctatcacagacgctgaaggcatttaaattttattttaaatcaaccaagagcccaaaaacccaacccatatttcgaaaaaactccaaggtgtactactcttgtttggttctgccatcctgccaccttacagtccttttgtttttcctattcttgcaggcaagtgcaaaacagtggtttttggaaggcaattcataattactctgaagctatttcggcatattttttactgattttttttttttttgagacagggtcttgctctgttgtccaggctggagtgcagtggcatgatcatggctcacagcagcctcagctccctggctcaagcgatcctctcgcctcagccnccgagtagcgggaccacaggatgcaccaccacaccgggcaaattttt

SEQ ID NO: 4647 - DNA, 270 bp, Homo sapiens
  misc_feature (1)...(270): n = A,T,C or G
ctttttnnaatttttaagtatttaaaaatttactcccattcatttttttatactcactctttctgatattatcttgacagtacccagtggattggaaaaacaggagtctttgcgttctgagaggacctcaggatagtttatatatagagccacaaagaattttcccagcttttgagggcagactgggatttgaaaaaaacaaaaaccannctctttaactgttcttctttaacngtgtcgtatanntggcgttggtgttcttgtctttgc

SEQ ID NO: 4648 - DNA, 455 bp, Homo sapiens
ggtatttaatgcttcttgagagcattaagagatgtatttcatggaaagtgtttaatattctgcctggcagtacaagagtaaattttcttcccactccagatcttgattcctctccttagagacagcagctgttactggtttcttttatgatgtctctgttgagatattttgatagaaaaagcagtaaaaaatggaaactgggcacatttctaggattttattgactttcttaaggaactttgacagatctgaaattttaccccatttgtaaggctaacaaggttaacctggcctcacgtttcatggatgctggcaggaggcagcatcctggggtcagtaggcagcatcgaacttcatgtcagttccctttggacattcatatctcacggtaagggaggagaccacccctcatattgtcttatgcccaatttctgcctccaaaaaaagaagaaggg

SEQ ID NO: 4649 - DNA, 526 bp, Homo sapiens
ttttttttttactttgaataatcttttatttccaattaactatgaaacaaacagttcagaaaaattccatgttgattttgcaaaaattttttttcttttgtatttttagtagagagggggtttcaccatgttggtcaggctagtcttgaactcctggcctcaggtgatccacctgccttggcctcccaaagtgctgggattacaggtgcgagccactgcacccagccaagaatttcagctccttggtgttaagagattattctttcatcaacagtgattagccaaaaacaacaaaaaaaggcttcaacggcccctttccaattctaatctcttcttcaggtacagagagcccggaggcgccaggatagccgtattggagacagggctcaggtgaggctcttaggcacgcagctgaagggagttcaccggcccagagggttgaagaccaacactaacattatgaacaaggcaggagttcctgctaacacacctcccactccctttcccttctcagatagaacccaac

SEQ ID NO: 4650 - DNA, 473 bp, Homo sapiens
  misc_feature (1)...(473): n = A,T,C or G
ttttttttattaattggattttttattgcaaatatttaatgacctaaaaacacagagggtaatactcccactggtgagatgaaaacttagctttgttttgggagcaaataaactcttcattatcagcactttctggggttggggaagtgcaggttgcctgtttaaaaacaaattaacttgttacaaacgattaaaacaaaaattacataccagaggtacaacctatgcagacaaacattaacaacaaatctacggagagaggttgtgtatgtgtnnncngtgggggggggtggggtagggagtatatgggaaatctttgtgcctttatttatttatttattatttatttattgagacagggtcttgctctgttgcccaggctggagtgcagtggtacaatccgtggctcactttagcctcgagctcctgggctcaagtgatcttcctgccgcagactccctgagtgactgggg

SEQ ID NO: 4651 - DNA, 725 bp, Homo sapiens
  misc_feature (1)...(725): n = A,T,C or G
gtggctttaaaaaagtttttaagatacatttaaatatggaagcaaagaaattgnaaaagaaaagctaaaaaattgggtccaaatttaactctgatcttcctaggatctgattcaaggatggaaacccaatcatgttttgtgattcattgctagaacaaagngggagaagtgggagaaccacaggctgaggaaaatttttccagacagatagtgtcacttcatgtatgacaacatttctaacaatattcctcacagaaattataaaggtgagttttatagggttaacactgcaaatattctcttcagttaacccatttatgcctagtgttccattattggaacgctaagcttgtgggagttcttcatatcctgctgtttaaggtcatcgccaaggtctgatttttcacacaaaaaatttgctacctctggcataaaagcaggaatagtatactggcaaagcacagtttagtacaaagcaattccacaagcgatcaaaaggatatgagctcactcatcatctggccagcccctcctgcataagtatttactactgtcaagcttttgataggtatatatcaagcagaaacgtgtggcagttatacaagaacctggaagtagatacatcacactgtggaagaaaagcagtcatgtaagctttaatcacttgcagtgctaccagaagggctggcatcctcaggagcctgactatgctagactagctatct

SEQ ID NO: 4652 - DNA, 448 bp, Homo sapiens
  misc_feature (1)...(448): n = A,T,C or G
ttttttttttttttttttttttttttttttttttttttagagacagagtcttgctgtgttgcccaggctggtcttgaacccctggcctcaagcgatcctcccacctcagcctccccaggtgttgggattacaggtgtgcgccactgcacctggtcattcttggggtttttaaaacaagctctccaggagattctggtgtgcaccaaagttggagaaggatttgtgtgcctaaatccagagagacggggaggtcagggcaggctggagtcggttcaggcttcagggaagagagtcctgagtttgtccttttcctaagaggagtctgagctatggccagggaagaggggggacagcttgggtgggctcccctccccagctctgaatcccttgccggttaacctaggntgctggtttcttgggccttccttgccctgnaaaacctgggtaa

SEQ ID NO: 4653 - DNA, 543 bp, Homo sapiens
  misc_feature (1)...(543): n = A,T,C or G
tcngaccgggagaatcaggcagggaggctgcagtgagccgagatggcagcagtacagtccagcttcggctcggcatcagagggagaccgtggaangagagagagaggaagaccgtggnntgagggagaagagagggagagggagagggctatttttaaaattttttaaaattgctgaacaggggtacctctgggcagtgtgtcagaataccactttttaaatattttatgatttatttatttttctatttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagctacttgggaaggctgaggcaggagaatcccccttgaacccaggaggcggaggttgcagagagccgagattgtaccactgcactccagcctgggtgacagagcaagactctatctcaaaaaaaaaaa

SEQ ID NO: 4654 - DNA, 651 bp, Homo sapiens
  misc_feature (1)...(651): n = A,T,C or G
ttcctctacaacttgatgaattttatttcattttcttgtgtaattgccctgctagaatctccaggacaatgttgagtaaaagtgatgagagtggacatccttatctaccttctgatgttagggagaaaacattattttttttttcactaatgagtaagatgttggctgtaggtttttcatagattgctatttttctatttgaggttttaactgatgtgtatctgtatgtctatttgtgtatattttgtcatgatcatgtaacagagtctgaaaagtgtcgaagagacagttttcaggaacaacaagcaattattcctactttccaagttattttgatgccatggtggctcatacctataatctgagtactttgggaggctgaggtggactgatcacttgagcccaggagtttgagaccagcctgggcaacatagcaagactccatctctacaaaaaaagacaaaatttagctgagcgtggtggcgtgttcctgtagtcccagctacttgggaggctgaagtgagtggntcccctgagcccagagaggtcaaggttgtgatgagctgtgatcacaccactncacttcagcatgggngacagagtgagaccctgtttcagaaaaaataactaaataaaaccnccngtaccaca

SEQ ID NO: 4655 - DNA, 834 bp, Homo sapiens
caatcctcttgcctcggcctcccaacgtgctgccatctcaggcgtgagcactgcacctggcccgaaaccaagctttctcatcccaagcgctgacctttatcaagtctagcctagtcctctatcatctcctaagtgtccctcatgagtgatcacttctgagtcctcctgcgtggagagctcacccactgggggcgtatctttcccattggaaaagtgtggttattggaagtttcctctttttagaaagaacaggattggaggtgctctctggggtgtcctcctaccaagctgactgttgaagtccttgtggtgctcagggaggatgggtgacactcgctgttgcttcagcttcatcttgagcccacacagcatctccactacccaggtctcctcaggctcaggggcgagctccttctccggctcctcctcagattcatctgaccactccctcttccttttccagccaagggacctacatggggggctgggatctaccccaggggctgagtaaagaaaccaggccaccgtgtaatgcttctgcatctgatcaccttagaccccgacccaaaaccccaaaccactctccatcctccccagcctcgcagactgctggcttctccaagccatctttctgactttctcctctgctcaaccccatgtgccgctccttcccctccccattcttccctctctctgtcctcagaacactgcttcatgtccttccctggtccctggctctctgagtccctccttttttgttttgttttgttttgacacagcgtcttgctttgtcacccaggctggagtgtagtggtgcaatctcagctcactgca

SEQ ID NO: 4656 - DNA, 458 bp, Homo sapiens
gtgtggttattggaagtttcctgtttttggaaagaacaggattggaggtgctctctggggtgtcctcctaccaagcagcctgttgaaggcctcgtggtgctcagggagcacgagcaacactcgccgtcgcttcagcttcatcttgaggccacacagcatctccgccacccagatctcctcaggctcaggggcgagcaccttccgtggctcctcctccaacgactcctcagattcgtcccaccactccctcttccttttccagcaaaaggacctacgcggggggctgggatctaccccaggggctgagtaaagaaaccaggccacggtgtaatgcttctgcagttgatcacactagagcccgacccaaaaccccaaatcactctccatcctccccagcctcccagactgctggcttctccaagccatcttcccttctgtcgtcttctcgcagccgtata

SEQ ID NO: 4657 - DNA, 2365 bp, Homo sapiens
gctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatattttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagtttaaaaaaaaaaaaaaaaaaaaaaaaaaaaaa

SEQ ID NO: 4658 - DNA, 584 bp, Homo sapiens
cttcaaggggccaaattcatctaaggtgaacatgtcgccctgtctgaaatggggcatctcaccatttaaacccgtgaaacatatccaagccctaaaaaaaagattgtcaattggaagcctgtaatttttaatgtagacatacttacacgcgaaagggttaaattcacagccttactagttcctggcttccagtatttcaattggtctcctccccacattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaaaaaaaaaaa

SEQ ID NO: 4659 - DNA, 535 bp, Homo sapiens
  misc_feature (1)...(535): n = A,T,C or G
agagagagagagagagagagagagagagagagagagagagagagagagagagagagagagagagagagagagagacaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttacttggtcaaaatgcatgtatagcatttctttcatcttagttccttgtgtttccctatgtggtcctttatatatttgttattgtatcggagaaacaaaactatcttcaaaaataagttaatttggatatatttgtcatatcaaactacaaagtgtacaaagttaagtttagcccttttctagaaagtgatctttaaaattaaaattgctcctcttttaaattcaccaaatttatgtgtggggaggnaccaaaatgattttgtagtgccc

SEQ ID NO: 4660 - DNA, 450 bp, Homo sapiens
gtcttcttgtctggcccaggctgggggcccagcattcctggaagggagagacagcccagcatctcagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttaaaaaaaaaa

SEQ ID NO: 4661 - DNA, 257 bp, Homo sapiens
  misc_feature (1)...(257): n = A,T,C or G
tagataatgagtcataaatagattctgccaactgaggggagaaacattttaagtaaatatttttcagtatttggggccttaaaaaataattattagtgattagtgttnntaagataatagattcaggtcttccaactatgcccttggattgtggcctactgtatgttattaaatggtctcttactatccaaaatgggagtagatgctgtggcccgtctccttggcttttacgtccatatccaccccattcatgtaca

SEQ ID NO: 4662 - DNA, 6323 bp, Homo sapiens
gatcaagttaacatgaggccagtaggagaagccctaatccaaaaggactagagtccttgtcaaaaggggaactttggacacagagatacacatacaggggggcggggggtggaaaacgtcacatgaagatgaaggtggggatcagtgtgatgcatctacaagtcaagggacaccaaagattgccgggaaaccaccaaaagccaggaaagagacacggaatagattctctctcacggtcttcagaaccaaccctgccaacaacttggccttgtacctctagcctccagaactgtgagacaataatgttttgttgtttaaagcttgatcagccttaagtttgtattagactggtgcaaaagtaattacagttttcgccattgctttcaatggcaaaaatcacaattacttttgcaccaacctaaatagtactgtgttatggcagctctgggaaatgaatacaaccattcagtgctgtgagggccacagacagatcacttgctcgctcacccaggttcacgggataaaccctggttatacggaacttctgggagccctgggttactgtaagtgccccctaactggactccctgtttcctgtcttactttctctaaccattctccacagcactgccctgatctttctaaaatccaaatctttcctatctcatggcttcacaagcttttacctgcctcccaatgtctttgggatacagcaaaatttctcagcttgaggccacaatgcccttggcatccggccccagcatatttctccaaccttatttctctcatctttgcattcactccctagccatacattttctaccccactcctaatgggaccaaacttccattcatcctgaggcctccacttagtcaccatctccaccggaaagccttcccaaagcacccaggaggggggtaggtgtccctcctatgtgctctccaaagccctttccttcaatgcctttgtggcatttatcacagtgtgttcaaggcctgtttgtcagttttctccctgtgaccatgagttcctatcttgtttgtatctccaggcaccaagaaagcacttggcacttggaggacattcagtggacggatgagaataaatgaacaaagcatgccatgttccaaccagctggtcccagaactattttgttctcctttaagggatgggggatgggcaggtgacctttccagggatttcccaatagtaggtagaaccactggagctggatggagctccacctttccttagtggttgcaagaggaatttagattagacattcaaaagctgtttcttgtgtcgaaagacacttgcagtacaaagaagggaaagtaaacaatcccgcgatttttcaggttgggttttaccaatattttagaatctgtttttttataggaagtggccccttcaggtatccaagcctctgatacggtaaactgcatgtcctgacctacaggtaaaggtggtgggaggttaggagaatagggaattgttgcaactaacaatgcaatgtgtcatgtgcccgtatctctaaaaagtaaatatttttgaggtttaaaaattatttgcctgcacggtttgccggagagcctggaagaggaaagaagacaagacacaaagtaacaacatttacaaaaatatgcctgactaggaaaagacagaggggtcatagacgaaaataatcaggattgggtctcttttgcaaattcctgaacggggaaatgtatcagaatttccagtcctcaagaaacagggcctttaaaagtcttgtgtgcaagaagggggaaaaagacgaggggggggcggggaggcggactcgctcttcgcagcaggaagtcttcaatggctatcgagttatgaagaaacaactgcccagaagtccttattcggagcgctaaactcgattttaccacataaagagcaatgtaaaagctcagaacagccccatcatggtgttggggaaacaactcggcttccccatgtgagaaagccagagagctccgacttggtagtagcccagacctgtgttaggggttttatttgcaagtcaatgaaccaaacgggcgaccaggctcgttgtgccgcgttgtggaagcaaggttattattatcgcccattgccccactgaacaatttcactgaaaaggaagagtcccagccgtgtgtgtgcgcgtggtgccatacgggacgtgcagctacgtgcccacctccagaacgactttatttacaaagcgattaccacgttatctatttgttttccttttccagcaagagcagccttactcagccctcaaatttcttaattacaaacccgtttgcttctaaatcaaccccaaaccgtcaggcagagcccggagggaggctctgcaagtttgtacacacccccacctcccggatccagggcaacagcagaagcaagtaactgtgtatgtgcaaaaaggtggatctggggacgaggatcgctgagtttgtttacagagcagagacgcctcagctcggatgccaaagctaccaagagctgcaaacgcaaacttagcagaagcacacgtaccccgggagcggcaggcgggcccgaaagcgcggactggaattccagggcgcgggagcgggggtggccgggccctcgagcgcgctccgtccacctgcagcggctgcccctccccgcccccagctcctgtccttgaaaggagtggaggaaaaaaatgcatctacaagcggtgatctagagtaggtctacccactgcccgtatgaaaacacaaaggcacagcctaggaaggcgcgctcaggaaagggcgcattatttgtccgggtctttaaaacccaactcgaggaagcacagccattcttcgctgcctgtggaagcttttgcaaaaccggggaggcacaagggcactctggagggcggggggcgctgggcgagtccccttttcccgtagagagcggggcagatcgctaggtgaaccgagtgagaaagctgggggtggggtagatccagcctgaggggggcggtgagctctcctcgtggctatcccggcaggctctaccttcgggcggggcggcaggggaggattttccccctgcctcgggggtggctgagccaacctcgcgtttctgggccgggaagaaaccagagtcggggggcgacggggcgactgggcggcccccgggccccgcagcctctgcagcacgtgccgcgggcggcggggacgcggctccgggacccggtccagggtgttcgcggtgttccggaatccgcgtcttggcgccgcccgccctggaggctctcgctccgcctttccgaaatgcctatattaactgtggccaaagccctaagaaacacagctcattgttggcagctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggtaagcgcgacgggcgaagctggctggggctcttgccagcccagtcctccgagggcagggtttgcccggaggaagaacgtgaggcgaaactggggaataacaacaggatgtgctacaacaggatgaggagggctgatttaatgcctgaagttcgcagcagggctacggggcacttccttttataggccacttcggggagcaaagggggtgtgggctcgggtccccccgcccgatcgcaggggaaggggctgtttgtgcagcgtccggctgtgttatgagtggtagctcttccgtggtggctagcccgggtgcacaggctgttagtgggatcttgggggtggtggttcgcagccgacgtgcgcccgggaatcctggggggcagaggcgagcaaaagtggggtgcgctgtggtgggcgacacgtgtggcgcgggtctcattatctgcccttttcacttccaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggcggctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcgaagggcagatattactgcacaaactgccatctcgcttcatttttttaactatgcatttgagtacagactaatttttaaaatatgctaaactggaagattaaacagatgtgggccaaactgttctggatcaggaaagtcatactgttcactttcaagttggctgtcccccccgccgccccccccacccccatatgtacagatgataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgaaaaaatacttgttaatttattctattttaatttgccaatgtcaataaaaagttaagaaataaaaaaaattctagaagtcatttgggggtggttgttccctttggtggcttttttccccccgtctttgagttgaacactattgatgagagtaagcattccaaaggataaattacaggacactaaaacaggtcatgatgagcttaagcggagagcaggatttaacataattggcataatgcttcattgttatcattgtaacatgcctcttggtgtgctttaatcaaaagctgcaaagttgtcactgcttttttttttttcttaattgccatcatatcaagtgtactccagagttagaaaggtttgcaatactcaacattatctttttcaatgggcaggaggcaaaaaaaatcaagtgtttctgtttatacctgattcaactacttaaatagaggtagattggaataatacactgattgattgatgggtggcattaaatataaatctacctttatctccagtgatgagagttttatttctcagcaaaagtgccaaggataggtacatattttctagcgtaatctctgaaacatgtctgactggtttatagttctgagaagaagagcgaaatcccccttgaagcctttgtccca

SEQ ID NO: 4663 - DNA, 1931 bp, Homo sapiens
agctgccgggcggtcctgccgagctgtgagggcaacggaggggaaataaaagggaacggctccgaatctgccccagcggccgctgcgagacctcggcgccgacatcgcgacagcgaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaagcacagcggcggcagcagcacccccggccgctcgggcggcagcagcacccccggcggctctggcagcagctcgggcggcggcgcgggcagcagcaacagcggcggcggcagcggcagcggcaacatgcccgcctccgtggcccacgtccccgctgcaatgctgccgcccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaaagaaacattcccttagacacagtatctcacttttcagatcttgaaaggtttgagaacttggaaacaaagtaaactataaacttgtacaaattggttttaaaaaaaattgctgccacttttttttcctgtttttgtttcgtttttgtagccttgacattcacccacctcccttatgtagttgaaatatctagctaacttggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaactttgaagggcagatattactgcacaaactgccatctcgcttcatttttttaactatgcatttgagtacagactaatttttaaaatatgctaaactggaagattaaacagatgtggcccaaactgttctggatcaggaaagtcatactgttcactttcaagttggctgtcccccccgccgcccccccccacccccatatgtacagatgataatagggtgtggaatgtcgtcagtggcaaacatttcacagattattttgtttctgtcttcaacatttttgacactgtgctaatagttatattcagtacatgaaaagatactactgtgttgaaagccttttaggaaattttgacagtatttttgtacaaaacatttttttgaaaaaatacttgttaatttattctattttaatttgccaatgtcaataaaaagttaagaaataaaaaaaaaaaaaaaaaa

SEQ ID NO: 4664 - DNA, 436 bp, Homo sapiens
  misc_feature (1)...(436): n = A,T,C or G
agagagagagagagagagagagagagagagagagagagagagagagagagagagagagagagagagagagagtagccttgacattcacccacctcccttatggagttgaaatatctagctaactgggtctttttcgttgtttgtttttactcctttccctcactttctccagtgctcaactgttagatattaatcttggcaaactgcttaatcttgtggattttgtagatggtttcaaatgactgaactgcattcagatttacgagtgaaaggaaaaattgcattagttggttgcatgaacttcggaggggcagatattactgcacaaactgccatctcgcttcattttttttaactatgcatttgagtacagactaatttttaaaatatgctaaactgggagattaaacagatgtgggccaaactgttcttggnn

SEQ ID NO: 4665 - DNA, 899 bp, Homo sapiens
gagggcaacggaggggaaataaaagggaacggctccgaatcggccccagcggccgctgcgagacctcggcgccgacatcgcgacagaagcgctttgcacgccaggaaggtcccctctatgtgctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatgggcgagcacatacactacggcgcgggcaacatgaatgccacgagcggcatcaggcatgcgatggggccggggactgtgaacggagggcaccccccgagcgcgctggcccccgcggccaggtttaacaactcccagttcatgggtcccccggtggccagccagggaggctccctgccggccagcatgcagctgcagaagctcaacaaccagtatttcaaccatcacccctacccccacaaccactacatgccggatttgcaccctgctgcaggccaccagatgaacgggacaaaccagcacttccgagattgcaaccccaatgtcatagacactgatttcatcgacgaggaagttcttatgtccttggtgatagaaatgggtttggaccgcatcaaggagctgcccgaactctggctggggcaaaacgagtttgattttatgacggacttcgtgtgcaaacagcagcccagcagagtgagctgttgactcgatcgaaaccccggcgaaagaaatcaaacccccaacttcttcggcgtgaattaaa

SEQ ID NO: 4666 - DNA, 495 bp, Homo sapiens
  misc_feature (1)...(495): n = A,T,C or G
ctgctgagccggtcctggacgcgacgagcccgccctcggtcttcggagcagaaatcgcaaaaacggaaggactggaaatggcagaccatatgatggccatgaaccacgggcgcttccccgacggcaccaatgggctgcaccatcaccctgcccaccgcatgggcatggggcagttcccgagcccccatcaccaccagcagcagcagccccagcacgccttcaacgccctaatggcgangcacatacactacggcgcgggcaacatgaatgccacgagcggcatcaggcatgcgatggggccggggactgtgaacggagggcaccccccggcgcgggcagcaagcaacanctggcggcggcanggcaangggcaaacattgcccnccttccgttggcccacgttccccgcttgcaattgcttgccgcncaaatgttnattagacacttgattttcaatcgacgangaagtttcttaatgttccttgggttgaatag

SEQ ID NO: 4667 - DNA, 501 bp, Homo sapiens
  misc_feature (1)...(501): n = A,T,C or G
tgactgctggattccgatctgcgccggagctgcgatgctagagcactcttgccacccccaccccacggacgtgttgcagtgatatcagaattttgcgtgcggtttacccgtgtttaactctttgcgtctcgttctgaatcgtatccacttgagcatcactagactgatctattttaacactggtggggggcagcgaggtcagttatgggtccttcctccttaaaggggtggacagttgactttgggcaaacctcttcgctctgtgggaacagtttccccttctgcaaaatgagggtttggattgtagtttctaagtttagctgtggcgtgcgaattcccaggangtagttctttaaaaattcaggtgctcaggcgtggagtgcaganctctgggtttttgcaagctagccagctgattctgatgcacaggttgacnttggagaaccnggatcagattgtncctagggtcccttccggcttaaaatcttcngtttcccttct

SEQ ID NO: 4668 - DNA, 573 bp, Homo sapiens
  misc_feature (1)...(573): n = A,T,C or G
attttacaggagcactggccagantccaggtattggggaagtggcacagtgtgcccaggaagcaggcaacgtatggcgacgctgggctgacctacacattttcaggcctcacgctgtctccaaagccctggatcccagttctagagcgcatccgggatcacgtctctggggtgactggacagaccttcaactttgtgctcatcaacaggtataaagatggctgtgaccacatcggggagcaccgagatgatgaaagagaactggcccctgggagccccattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagttaaaaaaaaaaaaaaaaaaaaaaaaaaaaaaaaaaaaaaaaa

SEQ ID NO: 4669 - DNA, 481 bp, Homo sapiens
cagagtccaggtattcgggaagtggcacagtgtgcccaggaagcaggcaacgtatggcgacgctgggctgacctacacattttcaggcctcacgctgtctccaaagccctggatcccagttctagagcgcatccgggatcacgtctctggggtataaagatggctgtgaccacatcggggagcaccgagatgatgaaagagaactggcccctgggaaccccaattgcctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacaaaaaaaaa

SEQ ID NO: 4670 - DNA, 709 bp, Homo sapiens
ctctctctctctctctctctctctctctctctctctctctctcctcgtgccggtgactgcgggattccgatctgcgccggagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtggggggcagcgaggacatggttttaaactttaaaatgaaaatgtgaaactaggaatgttgctgtgagaccccttggacaaacagatttttgcactggggatagaacttgaggcaatttctgtcttggcctcgccactggacgtcccttctttcctgtggggacaggatggacagattcctggtgaaaggggctcaagggggccttttgaggaagcaggaggagcaagagccaactggagaagagccagctgtgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtt

SEQ ID NO: 4671 - DNA, 405 bp, Homo sapiens
  misc_feature (1)...(405): n = A,T,C or G
caacagacctcttcagcgttggcttatcttagagcccactgtggacctcaagccctcgcagaaacaacggcaggtacagccatgcagagtgctgtttcacactgtgaggaaaacgagggctggcagtgctggtgagtttcaggagagggttgtttttatgcactgtgtttgttttctcattgcaggtataaagatggctgtgaccacatcggggagcaccgagatgatgaaagagaactggcccctgggagncccattgcctctgtctccttcggtgcctgcagagactttgtcttccggcataaggattcccgtgggaaaagcccctccaggagggtggcggtggtcaggctgccgctggccacgggagcttactaatgatgaaccacccgancaacacgcact

SEQ ID NO: 4672 - DNA, 611 bp, Homo sapiens
gagctgcgatgctagagcactcttgccacccccaccccacggacgtgttgcagtgatatcagaattttgcgtgcggtttacccgtgtttaacctctttgcgtctcgcttctgaatcgtatccacttgagcatcactagactgatctattttaacactggtgggggccagcaggacatggttttaaactttaaaatgaaaatgtgaaactaggaatgttgctgtgagaccccttggacaacagatttttgcactggggatagaactcgagcaatttctgtcttgggcctcgccactgacgtcccttctttcctgtggggacaggatggacagattcctggtgaaaggggctcaagggggccttttgaggaagcaggaggagcaagagccaactggagaagagccagctgtgttgggaggagacaaagaaagcacaaggaagaggcccaggagagaggccccagggattggaggccactcagcaggccctagctggcggcacattcgggctgagggcctggactgcagttacacagtcctgtttggcaaagctgaggcagatgagattttccaagagttggagaaagaagtagaatattttacaggagcactg

SEQ ID NO: 4673 - DNA, 441 bp, Homo sapiens
ggcacgagggtttacccgtgtttaacctctttgcgtctcgcttctgaatcgtatccacttgagcatcactagactgatctattttaacactggtggggggcagcgaggatggacagattcctggtgaaaggggctcaagggggccttttgaggaagcaggaggagcaagagccaactggagaagagccagctctgtctccttcggtgcctgcagagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagttaa

SEQ ID NO: 4674 - DNA, 297 bp, Homo sapiens
tgagggcctggactgcagttacacagtcctgtttggcaaagctgaggcagatgagattttccaagagttgaagactttgtcttccggcataaggattcccgtgggaaaagcccctccaggagggtggcggtggtcaggctgccgctggcccacgggagcttactaatgatgaaccacccgaccaacacgcactggtaccacagtcttcccgtgagaaagaaggttctggctccacgggtgaatctgacttttcgtaaaattttgcttactaaaaaataaaaacatttttaacagtta

SEQ ID NO: 4675 - DNA, 1010 bp, Homo sapiens
gcttaccctgtagcacagacagggactcctgctgccctgggagctgtctcaagcaaaatctcttgtcccagaggtgcccatgtgggtccgctgtgtcccctgtcatcatccttgttttttctcattttggccaagggacggctccctgggacaggcagggaacaactgcggagatattagtgattcataggtttgtacattgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccgttggctcctggcaggccagctgagaatgaacaggagatggaggcatgtctgagctgggtctgggtgtaggctgggaagcaggctggggtgtagactgcgaagacggccctgccgggacttctttccagttccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcgcaggctccggggcgccgcggccgc

SEQ ID NO: 4676 - DNA, 1774 bp, Homo sapiens
  misc_feature (1)...(1774): n = A,T,C or G
gagagagagagagagagagagagagagagagagagagagagagagagagagagagagagagagagaaaatctctngtcccagnggggcccatgngggtccgctgtgtcccctgtcatcatccttgttttttctcattttggccaagggcaggctccctgggacaggcagggnacaactgcggagatattagtgattcataggtttgtacagtgttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctctaggcacccccgcctcccgccaggctccccgattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggccccagagcctagcttcccctcagcctgggggacatcacagcatttcagtgtcagtcacattttaaactgatcagcctttgtataatgttttttaaatcatttctaaataaaacagaaatacagagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgacctgggacacatagtcaagagcacggttatcagcaatacagatattaataaaaggcagacgaagtcaggaggtcagcaactttgcgggcttaccaggaggcctgtcctgcctctggaagccagcgacagagagggatgcccccgacccagccagccggagaaagggatggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcgggctggggctggggctggggctggggctggggctggggcggatgccggggctgttccgggccctccggcgccgcaggctggggctggggctggggctgggtttgcgcaggctccggggcgccgcggccgcc

SEQ ID NO: 4677 - DNA, 1066 bp, Homo sapiens
tttttttttttttttttttttttttgtataatttgcaaatatcttcaaaaactaacacctggccccttacatgaaagaggggggaggcccggggaggccgacggtaactctcaccgggccctcaaatgaaccacaaaaaggttgttacttgcccgggccatccagggggctggctgggtcttgtgtccccatctgtggacccctctagggtctgagatgagatgagaagtgtctcctgtatccacctcttcctggcctcccttcccccacttcctggtccctgtccactcctcaggttggtgctctcacttcttgaaagctttaggcacccccgcctcccgccaggctccccattggctcctggcaggccagctgagaatgaacaggagatggaggcaggcagcccaggctgcagaggtgagggatgtggggccaggcccagagggctcagcctagaggcttccaatctcagattctcctgcctgtggtcatctgtttgtccatcaccccaggacagggcagacagaggggcaaagcactgggggggacatcacagcatttcagtgtcagtcacattttaaactgatcagcctttgtataatgttttttaaatcatttctaaataaaacaaaaaaaaaaaagtgtgtcatttccctgggatgagggaacaaagatcaggttccaagagtaaccttaggacgctctgggaagagaaccgggtcctttggggtgtctgggagctgcccacccatctcctctgccagaccggcggtcagatagcctccctctacaacaggctggccctgggggcccagggttattggggttccaggaacacagcctgatgatgcctccttacgatccaggatggagagcagcccccccaggagtatggggagggtcactgtggcacgggcttctccatgacctgggacatgaccaggaggcctgtcctgcctctggaagccagcgacagagagggatgcccccgacccagccagccggagaaagggatggggtggtcacgaaggtctgagctgggtctgggtgtaggctgggaagcagg

SEQ ID NO: 4678 - DNA, 467 bp, Homo sapiens
tttttttatactttgcaaagcactttattagctcacacctgtccactcacatgaaactcgtgttaggccctgggaggccgacggtaactctcaccgtgccctcagatgaagcacagagaggttgttacttgcccgggccatccagtgggctggggtggtcacgaaggtctgagctgggtctgggtgtaggctgggaagcaggctggggtgtagactgcgaaggcggccctgccgggacttctttccagtccccggcgacctcttcgaattctctgctatctctggggagcctcgggtgggagggggtgtaagagacgcagggacgtggggagaggagacaaggcaggcaagaaccacaggggacggcggacagacgggcgacatcctgcggaggacgccgtcagtaccaggaagtgcaggcgatgaggaagcgcacgtcgtccagcggcccccacgggctgggctcg

SEQ ID NO: 4679 - DNA, 561 bp, Homo sapiens
  misc_feature (1)...(561): n = A,T,C or G
accccctgaatcnaaattcaanagcctngccccactaaaaaancacaaggnaggccggatggccccaacaacccgactttgccctcatcgaagggaaggaatgacagatgaggaggcccttggtgcccctatagcaagccccagtttccccatctcccaggtggccacagctcatcaggaacagcttcttcctaagggatcccactggaccctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaaaaaaaaaaaaaa

SEQ ID NO: 4680 - DNA, 309 bp, Homo sapiens
  misc_feature (1)...(309): n = A,T,C or G
gagagagagagagagagagagagagagagagagagagagagagagagagagagagagagatgggggggccttggtgccctatagcaagcccagtttcccatctccaggggggccacagctcatcaggnacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacagagctgctctgaggcccatcagg

SEQ ID NO: 4681 - DNA, 1537 bp, Homo sapiens
  misc_feature (1)...(1537): n = A,T,C or G
taagtcctaaaggaatgcttcagaaaacctanaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatattagttaagaacccatcaagcttataccaaatgtctttattataaaaatatttatacaactagaaaataatcctaagacaactttagatactcaaggtttatcaccatagggcactacagtaaaatattatgttacaaaagtagggaggtcca

SEQ ID NO: 4682 - DNA, 1244 bp, Homo sapiens
cattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgaaaaaaaaaaaaaaaaaa

SEQ ID NO: 4683 - DNA, 480 bp, Homo sapiens
  misc_feature (1)...(480): n = A,T,C or G
ctggctaaaatttttatattgttcagagttgaagttggtgaagacnttcatgatgtaagcaccagatccngaagggggttaaatctactttgaaatgaatctgcaatcagtatttcagagctgttctggnaattntagtgatcttatttgattagacttttncagaagtnctaaataaggaatttnaacaggtnnntnttantgcacagataaatagaagtacagagaggnctatagccatnctctttanaatagnccncnnnnnanannncnncnnnctcttnnantnnnttccctttncttcnctccncnccnccnnncccccncncccccaatccnccancccttntccccnnntnttcccccnttcattctcccnnncccctcccccnncccnnctctcctcncccatcccctactctcancccccntccctcncctcctnccttcccnccttncccctcaancaccctcnacaaa

SEQ ID NO: 4684 - DNA, 412 bp, Homo sapiens
  misc_feature (1)...(412): n = A,T,C or G
accggcaaanccttaccaaagggaaacccccagccaataccccgcccctagtccttggcccataaaaaacaaccacctggtgggttgtattgtagcctattacctaataccagcaacattnccttcaattagcagncctagacattttataaacagaaatcctnggacccaattgataatatttcctgactgtattaatattttagtgcctataaaatactatgtgaatctcntaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaaattaaacttg

SEQ ID NO: 4685 - DNA, 317 bp, Homo sapiens
  misc_feature (1)...(317): n = A,T,C or G
gagagagagagagagagagagagagagagagagagagagagagagagagagagagagagagagagaggtttcaccatgtnggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagngggnaactgggagccaaacactntacagtattgtgtagaaagtcacc

SEQ ID NO: 4686 - DNA, 2668 bp, Homo sapiens
  misc_feature (1)...(2668): n = A,T,C or G
tcccaacttttttattctctagttcctagtctagcgttttcaagcacctcttcaaatcctgataaccttttgctgggagggggagttaatgagtctataatgattctgagacagagaacccctaagataaagtggaggaaaaacgtcctttatacatgattagatatgctcagggggtacagattaagaagtaaatgcaatggatttttttttttatagtaacaggaaatatttaattttccaatctccactttccatttttataaactgaaagaaaaaaatttaatatattacaaaatatctgtacatagacaagatacacccaatgggggtcaaaaacgagagagaaaggaatcagtgtcaggaacctaaatcagggagaatgaggtggcaactgacacttttctgatgcagcattctctctcaaaacctgctggtaaccattttagcacggtaactatatatgcatattatatatacacacacacatacaagtggttgggtgatgtctatggcataagctaatagaagttctacttgcaaatttgtgctaactgccctgctttaaacgtatagatttgatgttgctttcaaatacttatcgttcctatggacagttgaagaaaaaactaaggaaactgggtcaagtatatttgttttcaaaaccacaaaaatgatcacggtcaaaccagttttgcctcccactcatgaacagaatcagatttctcatctgttcaaaataatgtatttaatagacaatatctctcattgtacaataattaaaacaaaacgaaaaccacttttgaatggaattaattgggtctgtaattttcaaatagtcaaggtgaaattctgccaaacctttacttccatcatgtttatagataacgtaactgaaaaattaacaaataccttttcttcctccatacagattccaggatatttaaataagtttttttttctcctctgcttttagaaatagtcaaaactaccaaactttgttttcattttaaaagactcccaaaatgggggtgggggtgagatgggatcatacatacacatacactcacacatacactcacccccttccctagtagggatgagggaatggaggcttaagtatattatttaggatatttggcataattaaaaataagaggtgggagaggggagggaaaaacattattgatgactgctgataaccaaaatacaatgaaatatatagagaattttattcatatttgatgggaaaccaactttttttcattgaacagatacttctgaaagtatcccaggctcacgttctttaataaaaaacagggagtggggcccaataactcaaattcaaatattctaaaacacaaaggcccatgtctgaggactaagaagtcaacagacagaaggttcagatgaactttaatgcgatttaccaatagcatgtcagtaagcctagtaaatctaactggacacactggtataaaaagccatcaatgccaaaatagctagaaggctctctttctaaatcagtgtttggccctggaggcaaggccagatcaaaaaccagagaataataaagaaatacacacaccgatatctagctatatctcattaacaggggaaaacagtcttcaagtaagtatctgaagagggttcttctttcatttctttaaagtttttttttttttaagtaatgcacctttctcttataagtagattttattttttaaaataagaacttggcattgaaacatgaaacttgagttttgaaaactaccctccaagatgctgaagtatgtttactttttctttgtaaaagggggcttaacctatgtttcctgaaggtctaagtctgtgcagataaattatatgacatgtatctgtttttaaaacactctatatgctggtactcacatagaaatagaagccagaatgagaagcctcccaaattatcccatcctgacagcccttccctttttcatttcctgtttatgataaggcaaagttcttgcctggaagcacaatttaaccccttttaccaaaaccaaatccaaatctctttggaggaaaaatccctaaaagaactggcagggtacacatgctgggatgtgggtatgtcaatactgttcttcctcacagtatgctgttttaaaattatttttttaaaaaaggtcaggtattgatgtatcttcagaaaaatacccaccctaaactaggttacatttccatgtatcttcaggatttgtttttctctttgacaatatcacaatgctctgtttgaaaggtttttgtttttttttttgacataaaaatatatgtgtaaacaatatgctaaatgctgttattagccctctaggaatggaggcatcatctctaaccacagctcagcagcaatgtccaagctgtccacacttacaaatcaacttccccatcagaacatggtttaaaaaacaaaacattttaganttgaagagttacagagancantgtaagagtctgantttcctttcctttntttcaaaaaaagtaaagatttntcccagggttcttggggcatctcaacgnttttttccaaacaantgcctcaaagaggagaggaancagcgagaggngccaagcgaggacagaggagagaggagagagagagagagagagagagagagagngagag

SEQ ID NO: 4687 - DNA, 475 bp, Homo sapiens
  misc_feature (1)...(475): n = A,T,C or G
atagtaacagntttntatttaattttccaatctccactttccatttttataaactgaaagaaaaaaatttaatatattacaaaatatctgtacatagacaagatacacccaatgggggtcaaaaacgagagagaaaggaatcagtgtcaggaacctaaatcagggagaatgaggtggcaactgacacttttctgatgcagcattctctctcaaaacctgctggtaaccattttagcacggtaactatatatgcatattatatatacacacacacatacaagtgggttggggtgatgtctatgggcataagctaataggaagttctacttgcaaatttgtggctaactgcccngcttttaaacgtattgggntttggatggttggcctttccaaatacnttttccgttcccctggggccagtttggagggnaaaacncaggggnaccgggggccagggttttttggtttttccatt

SEQ ID NO: 4688 - protein, 8 aa, Artificial Sequence
  Synthetic epitope tag
DYKDDDDK

SEQ ID NO: 4689 - DNA, 22 bp, Artificial Sequence
  Primer
caagcgatagttctaattttct

SEQ ID NO: 4690 - DNA, 22 bp, Artificial Sequence
  Primer
tggtgttctctgagcttccagg

SEQ ID NO: 4691 - DNA, 22 bp, Artificial Sequence
  Primer
gtcttgattttaaggtttgagg

SEQ ID NO: 4692 - DNA, 22 bp, Artificial Sequence
  Primer
gctgcttccagcatttcagcat

SEQ ID NO: 4693 - DNA, 22 bp, Artificial Sequence
  Primer
atgatgcagtgagtgagaccca

SEQ ID NO: 4694 - DNA, 22 bp, Artificial Sequence
  Primer
gcactgggtcttctcatctgct

SEQ ID NO: 4695 - DNA, 22 bp, Artificial Sequence
  Primer
cacgagagtctagtgggggttt

SEQ ID NO: 4696 - DNA, 22 bp, Artificial Sequence
  Primer
tcccctgatatccactatcttt

SEQ ID NO: 4697 - DNA, 22 bp, Artificial Sequence
  Primer
actgtctcattctttacagaaa

SEQ ID NO: 4698 - DNA, 22 bp, Artificial Sequence
  Primer
caggtctctgcagagcatttct

SEQ ID NO: 4699 - DNA, 22 bp, Artificial Sequence
  Primer
gcagacaatatcaagagttctt

SEQ ID NO: 4700 - DNA, 22 bp, Artificial Sequence
  Primer
tcatctgccaagtgagcccagt

SEQ ID NO: 4701 - DNA, 22 bp, Artificial Sequence
  Primer
gataccaatgtgaagtccttga

SEQ ID NO: 4702 - DNA, 22 bp, Artificial Sequence
  Primer
tctcgatcccactaaccacgat

SEQ ID NO: 4703 - DNA, 22 bp, Artificial Sequence
  Primer
actggaatgctcagctggatgc

SEQ ID NO: 4704 - DNA, 22 bp, Artificial Sequence
  Primer
tgctgatctctcagttcaccct

SEQ ID NO: 4705 - DNA, 22 bp, Artificial Sequence
  Primer
atctaatgctgtggccgctgct

SEQ ID NO: 4706 - DNA, 22 bp, Artificial Sequence
  Primer
gacagccagaggaaacctcttc

SEQ ID NO: 4707 - DNA, 22 bp, Artificial Sequence
  Primer
cacctctggctttcctacaacc

SEQ ID NO: 4708 - DNA, 22 bp, Artificial Sequence
  Primer
agcttcgtctgaccagtctacc

SEQ ID NO: 4709 - DNA, 22 bp, Artificial Sequence
  Primer
tgcctgtgactgaagtcttgat

SEQ ID NO: 4710 - DNA, 22 bp, Artificial Sequence
  Primer
aggaagaacagaagcagtcttt

SEQ ID NO: 4711 - DNA, 22 bp, Artificial Sequence
  Primer
tcctgggaagcaagaataggaa

SEQ ID NO: 4712 - DNA, 22 bp, Artificial Sequence
  Primer
actgttgtcacctctgggaaag

SEQ ID NO: 4713 - DNA, 22 bp, Artificial Sequence
  Primer
gagtaaaagaatgtgtataggg

SEQ ID NO: 4714 - DNA, 22 bp, Artificial Sequence
  Primer
tatgtgttggagccagaaaatt

SEQ ID NO: 4715 - DNA, 22 bp, Artificial Sequence
  Primer
accgaaccaaagatcctggaag

SEQ ID NO: 4716 - DNA, 22 bp, Artificial Sequence
  Primer
ctgccctcaccttgcctcaaac

SEQ ID NO: 4717 - DNA, 22 bp, Artificial Sequence
  Primer
cagtgttatatgtgatgctgaa

SEQ ID NO: 4718 - DNA, 22 bp, Artificial Sequence
  Primer
cttactcactacactgggtctc

SEQ ID NO: 4719 - DNA, 22 bp, Artificial Sequence
  Primer
actctcgtggatagagcagatg

SEQ ID NO: 4720 - DNA, 22 bp, Artificial Sequence
  Primer
tcacttggcagatgaaaccccc

SEQ ID NO: 4721 - DNA, 22 bp, Artificial Sequence
  Primer
cattagatgatggtaaagatag

SEQ ID NO: 4722 - DNA, 22 bp, Artificial Sequence
  Primer
ggaacagcaaacgttttctgta

SEQ ID NO: 4723 - DNA, 22 bp, Artificial Sequence
  Primer
gactcttgttaacgagaaatgc

SEQ ID NO: 4724 - DNA, 22 bp, Artificial Sequence
  Primer
ctgtaacacatctcaagaactc

SEQ ID NO: 4725 - DNA, 22 bp, Artificial Sequence
  Primer
gacctcaccaaagcactgggct

SEQ ID NO: 4726 - DNA, 22 bp, Artificial Sequence
  Primer
gttttcttccagcctcaaggac

SEQ ID NO: 4727 - DNA, 22 bp, Artificial Sequence
  Primer
atgaagtacattggatcgtggt

SEQ ID NO: 4728 - DNA, 22 bp, Artificial Sequence
  Primer
ttctccagggtcaagcatccag

SEQ ID NO: 4729 - DNA, 22 bp, Artificial Sequence
  Primer
gcaagccacccatcagggtgaa

SEQ ID NO: 4730 - DNA, 22 bp, Artificial Sequence
  Primer
ggtttgtttgctgcagcagcgg

SEQ ID NO: 4731 - DNA, 22 bp, Artificial Sequence
  Primer
aaaagttgtcttgggaagaggt

SEQ ID NO: 4732 - DNA, 22 bp, Artificial Sequence
  Primer
agctgtgacatgaaggttgtag

SEQ ID NO: 4733 - DNA, 22 bp, Artificial Sequence
  Primer
ttcaggaaccaccaggtagact

SEQ ID NO: 4734 - DNA, 22 bp, Artificial Sequence
  Primer
gagtgagtaaggaaatcaagac

SEQ ID NO: 4735 - DNA, 22 bp, Artificial Sequence
  Primer
gtcattatttcctcaaagactg

SEQ ID NO: 4736 - DNA, 22 bp, Artificial Sequence
  Primer
tcgcagtggctttgttcctatt

SEQ ID NO: 4737 - DNA, 22 bp, Artificial Sequence
  Primer
agtcttccaggtctctttccca

SEQ ID NO: 4738 - DNA, 22 bp, Artificial Sequence
  Primer
ttttttgacccaccccctatac

SEQ ID NO: 4739 - DNA, 22 bp, Artificial Sequence
  Primer
cgaggaagatgtaagagactgt

SEQ ID NO: 4740 - DNA, 22 bp, Artificial Sequence
  Primer
tctttagtcctttgggagagct

SEQ ID NO: 4741 - DNA, 22 bp, Artificial Sequence
  Primer
aggtgctacctcgctcaatctg

SEQ ID NO: 4742 - DNA, 22 bp, Artificial Sequence
  Primer
cttttgaagacgtgggttctgt

SEQ ID NO: 4743 - DNA, 22 bp, Artificial Sequence
  Primer
agccataaacacacatttctat

SEQ ID NO: 4744 - DNA, 22 bp, Artificial Sequence
  Primer
tccactgagagttaccaaaccc

SEQ ID NO: 4745 - DNA, 22 bp, Artificial Sequence
  Primer
gttcagattttatcttgggtat

SEQ ID NO: 4746 - DNA, 22 bp, Artificial Sequence
  Primer
gaggtccctattgctgtgtttt

SEQ ID NO: 4747 - DNA, 22 bp, Artificial Sequence
  Primer
atctgtagcctatagtgaacag

SEQ ID NO: 4748 - DNA, 22 bp, Artificial Sequence
  Primer
gtagtaacagaatggactttga

SEQ ID NO: 4749 - DNA, 22 bp, Artificial Sequence
  Primer
ctctgcatttcttactccttac

SEQ ID NO: 4750 - DNA, 22 bp, Artificial Sequence
  Primer
tcgcaaatagcacaagggactt

SEQ ID NO: 4751 - DNA, 22 bp, Artificial Sequence
  Primer
tgaagttcggaatccctgatag

SEQ ID NO: 4752 - DNA, 22 bp, Artificial Sequence
  Primer
agcagaagagcagacccttcaa

SEQ ID NO: 4753 - DNA, 22 bp, Artificial Sequence
  Primer
agatgcttatacttggtgtaag

SEQ ID NO: 4754 - DNA, 22 bp, Artificial Sequence
  Primer
agtcacaccttatgaggcatca

SEQ ID NO: 4755 - DNA, 22 bp, Artificial Sequence
  Primer
atcctgctttgtgggtagccac

SEQ ID NO: 4756 - DNA, 22 bp, Artificial Sequence
  Primer
actcaaaccaaccttccattca

SEQ ID NO: 4757 - DNA, 22 bp, Artificial Sequence
  Primer
tcagttctcagtcctaggagac

SEQ ID NO: 4758 - DNA, 22 bp, Artificial Sequence
  Primer
gcgaggcctgctgtctttctca

SEQ ID NO: 4759 - DNA, 22 bp, Artificial Sequence
  Primer
gcagagaggtggtgagtgcatc

SEQ ID NO: 4760 - DNA, 22 bp, Artificial Sequence
  Primer
tgcttatcaagatgcctttgcc

SEQ ID NO: 4761 - DNA, 22 bp, Artificial Sequence
  Primer
ccatccttcatccccagcagta

SEQ ID NO: 4762 - DNA, 22 bp, Artificial Sequence
  Primer
agaaccaggcagagctacctgg

SEQ ID NO: 4763 - DNA, 22 bp, Artificial Sequence
  Primer
actagctattgaagtgactatc

SEQ ID NO: 4764 - DNA, 22 bp, Artificial Sequence
  Primer
gtttcagctgtggaaaatgtta

SEQ ID NO: 4765 - DNA, 22 bp, Artificial Sequence
  Primer
atgctgcttcatataacacatt

SEQ ID NO: 4766 - DNA, 22 bp, Artificial Sequence
  Primer
ctcgctccatctgcgatgcaca

SEQ ID NO: 4767 - DNA, 22 bp, Artificial Sequence
  Primer
tgttgtgtcagaaactcaggaa

SEQ ID NO: 4768 - DNA, 22 bp, Artificial Sequence
  Primer
attgaggccccagaacagtctc

SEQ ID NO: 4769 - DNA, 22 bp, Artificial Sequence
  Primer
attttcccacaggaagctctcc

SEQ ID NO: 4770 - DNA, 22 bp, Artificial Sequence
  Primer
gggctggttgctcacagattga

SEQ ID NO: 4771 - DNA, 22 bp, Artificial Sequence
  Primer
gaatgcaagcactcacagaacc

SEQ ID NO: 4772 - DNA, 22 bp, Artificial Sequence
  Primer
gatgctctgtgcatatagaaat

SEQ ID NO: 4773 - DNA, 22 bp, Artificial Sequence
  Primer
ggtatgagaattgtgggtttgg

SEQ ID NO: 4774 - DNA, 22 bp, Artificial Sequence
  Primer
actgatgacatttgatacccaa

SEQ ID NO: 4775 - DNA, 22 bp, Artificial Sequence
  Primer
cagccaatgaagtcaaaacaca

SEQ ID NO: 4776 - DNA, 22 bp, Artificial Sequence
  Primer
tttacagtgtttgcctgttcac

SEQ ID NO: 4777 - DNA, 22 bp, Artificial Sequence
  Primer
agagaggaacagcatcaaagtc

SEQ ID NO: 4778 - DNA, 22 bp, Artificial Sequence
  Primer
aagctttactaccagtaaggag

SEQ ID NO: 4779 - DNA, 22 bp, Artificial Sequence
  Primer
caccgttatgcagaaagtccct

SEQ ID NO: 4780 - DNA, 22 bp, Artificial Sequence
  Primer
aggttcctactgagctatcagg

SEQ ID NO: 4781 - DNA, 22 bp, Artificial Sequence
  Primer
ggagcatccaatctttgaaggg

SEQ ID NO: 4782 - DNA, 22 bp, Artificial Sequence
  Primer
tacttacacagttgcttacacc

SEQ ID NO: 4783 - DNA, 22 bp, Artificial Sequence
  Primer
ctgtatgaatcctctgatgcct

SEQ ID NO: 4784 - DNA, 22 bp, Artificial Sequence
  Primer
aatgccacggtgcagtggctac

SEQ ID NO: 4785 - DNA, 22 bp, Artificial Sequence
  Primer
ggttaggattagtgtgaatgga

SEQ ID NO: 4786 - DNA, 22 bp, Artificial Sequence
  Primer
ggtcttctactccagtctccta

SEQ ID NO: 4787 - DNA, 22 bp, Artificial Sequence
  Primer
aaattagccaggcatgagaaag

SEQ ID NO: 4788 - DNA, 22 bp, Artificial Sequence
  Primer
tgacagtttcctttgatgcact

SEQ ID NO: 4789 - DNA, 22 bp, Artificial Sequence
  Primer
aatcaggccatgagggcaaagg

SEQ ID NO: 4790 - DNA, 22 bp, Artificial Sequence
  Primer
ccctgaatttaggttactgctg

SEQ ID NO: 4791 - DNA, 22 bp, Artificial Sequence
  Primer
ctggaccaggaaatccaggtag

SEQ ID NO: 4792 - DNA, 22 bp, Artificial Sequence
  Primer
atgggcaaagaatagatagtca

SEQ ID NO: 4793 - DNA, 22 bp, Artificial Sequence
  Primer
tgtcttcctccccttaacattt

SEQ ID NO: 4794 - DNA, 22 bp, Artificial Sequence
  Primer
cgggaagcatttgcaatgtgtt

SEQ ID NO: 4795 - DNA, 22 bp, Artificial Sequence
  Primer
aggtgatcacagactgtgcatc

SEQ ID NO: 4796 - DNA, 22 bp, Artificial Sequence
  Primer
acccagctgaatccttcctgag

SEQ ID NO: 4797 - DNA, 22 bp, Artificial Sequence
  Primer
tcatgggggtgctttgaccttg

SEQ ID NO: 4798 - DNA, 22 bp, Artificial Sequence
  Primer
catggtcacctgcagcctctca

SEQ ID NO: 4799 - DNA, 22 bp, Artificial Sequence
  Primer
agaagcggggtgagcaggacat

SEQ ID NO: 4800 - DNA, 22 bp, Artificial Sequence
  Primer
gatgttgtccgacaggcatggg

SEQ ID NO: 4801 - DNA, 22 bp, Artificial Sequence
  Primer
gtggtagaattggcaagccttg

SEQ ID NO: 4802 - DNA, 22 bp, Artificial Sequence
  Primer
ggtaaggacaccttcaagggac

SEQ ID NO: 4803 - DNA, 22 bp, Artificial Sequence
  Primer
atgcaaaggtctcaggacgaaa

SEQ ID NO: 4804 - DNA, 22 bp, Artificial Sequence
  Primer
ggcatgtagatcaaatgaaata

SEQ ID NO: 4805 - DNA, 22 bp, Artificial Sequence
  Primer
ggtagcagtcttacactgctgg

SEQ ID NO: 4806 - DNA, 22 bp, Artificial Sequence
  Primer
tgccatgtaacgttcatattcc

SEQ ID NO: 4807 - DNA, 22 bp, Artificial Sequence
  Primer
atacccacagggtagtaacagt

SEQ ID NO: 4808 - DNA, 22 bp, Artificial Sequence
  Primer
cgtgagcccatttcaaccacac

SEQ ID NO: 4809 - DNA, 22 bp, Artificial Sequence
  Primer
acatatgaaaagaccgtagaaa

SEQ ID NO: 4810 - DNA, 22 bp, Artificial Sequence
  Primer
acgtggagaaggccgctgtctt

SEQ ID NO: 4811 - DNA, 22 bp, Artificial Sequence
  Primer
tgaattttaacaggtggcaaag

SEQ ID NO: 4812 - DNA, 22 bp, Artificial Sequence
  Primer
ctcatagttgttacacactctg

SEQ ID NO: 4813 - DNA, 22 bp, Artificial Sequence
  Primer
ctccataggaagcagccatcag

SEQ ID NO: 4814 - DNA, 22 bp, Artificial Sequence
  Primer
tgtaccaaactgttgactatta

SEQ ID NO: 4815 - DNA, 22 bp, Artificial Sequence
  Primer
gcctgcacaggacacaattgca

SEQ ID NO: 4816 - DNA, 22 bp, Artificial Sequence
  Primer
caataattagttccaatggcgc

SEQ ID NO: 4817 - DNA, 22 bp, Artificial Sequence
  Primer
gagtgctcaccggaagagaaga

SEQ ID NO: 4818 - DNA, 22 bp, Artificial Sequence
  Primer
tgcctttcttccttagagctcc

SEQ ID NO: 4819 - DNA, 22 bp, Artificial Sequence
  Primer
tgtgggatgcttccagttttgt

SEQ ID NO: 4820 - DNA, 22 bp, Artificial Sequence
  Primer
catcctgcctcgggtctgaact

SEQ ID NO: 4821 - DNA, 22 bp, Artificial Sequence
  Primer
aagaaggacctcaaccaagagc

SEQ ID NO: 4822 - DNA, 22 bp, Artificial Sequence
  Primer
tattacagaggctggtgatcag

SEQ ID NO: 4823 - DNA, 22 bp, Artificial Sequence
  Primer
gacaacttgcttcctttacctg

SEQ ID NO: 4824 - DNA, 22 bp, Artificial Sequence
  Primer
cagaagcatagaaacaatccag

SEQ ID NO: 4825 - DNA, 22 bp, Artificial Sequence
  Primer
tgctgcaactgccaaagaattc

SEQ ID NO: 4826 - DNA, 22 bp, Artificial Sequence
  Primer
tggcctcaaaggctcaaggtca

SEQ ID NO: 4827 - DNA, 22 bp, Artificial Sequence
  Primer
tggctagaaggaggtgagaggc

SEQ ID NO: 4828 - DNA, 22 bp, Artificial Sequence
  Primer
gttacccgggagttatgtcctg

SEQ ID NO: 4829 - DNA, 22 bp, Artificial Sequence
  Primer
ttcctgtgtagatccccatgcc

SEQ ID NO: 4830 - DNA, 22 bp, Artificial Sequence
  Primer
ctccaatcagttgccaaggctt

SEQ ID NO: 4831 - DNA, 22 bp, Artificial Sequence
  Primer
tggagtgccctgttgtcccttg

SEQ ID NO: 4832 - DNA, 22 bp, Artificial Sequence
  Primer
cccttcctggacaatttcgtcc

SEQ ID NO: 4833 - DNA, 22 bp, Artificial Sequence
  Primer
tgctcctagctgaatatttcat

SEQ ID NO: 4834 - DNA, 22 bp, Artificial Sequence
  Primer
cctttccgatgaccccagcagt

SEQ ID NO: 4835 - DNA, 22 bp, Artificial Sequence
  Primer
gttttcctgtgcagggaatatg

SEQ ID NO: 4836 - DNA, 22 bp, Artificial Sequence
  Primer
ttgtggctcaaatcactgttac

SEQ ID NO: 4837 - DNA, 22 bp, Artificial Sequence
  Primer
tccctgtctttgaagtgtggtt

SEQ ID NO: 4838 - DNA, 22 bp, Artificial Sequence
  Primer
caattcacaggcactttctacg

SEQ ID NO: 4839 - DNA, 22 bp, Artificial Sequence
  Primer
ctggacattgaataaagacagc

SEQ ID NO: 4840 - DNA, 22 bp, Artificial Sequence
  Primer
attccatctgacagctttgcca

SEQ ID NO: 4841 - DNA, 22 bp, Artificial Sequence
  Primer
aagcacgtgttgaacagagtgt

SEQ ID NO: 4842 - DNA, 22 bp, Artificial Sequence
  Primer
actggacccagcaactgatggc

SEQ ID NO: 4843 - DNA, 22 bp, Artificial Sequence
  Primer
gtttgcctcatgcttaatagtc

SEQ ID NO: 4844 - DNA, 22 bp, Artificial Sequence
  Primer
ttccgggtttgatgtgcaattg

SEQ ID NO: 4845 - DNA, 22 bp, Artificial Sequence
  Primer
cacagtcagagttggcgccatt

SEQ ID NO: 4846 - DNA, 22 bp, Artificial Sequence
  Primer
tccagagccaactgtcttctct

SEQ ID NO: 4847 - DNA, 22 bp, Artificial Sequence
  Primer
catctggattagctggagctct

SEQ ID NO: 4848 - DNA, 22 bp, Artificial Sequence
  Primer
gatgagtagatcccacaaaact

SEQ ID NO: 4849 - DNA, 22 bp, Artificial Sequence
  Primer
ggtcactgcaggaaagttcaga

SEQ ID NO: 4850 - DNA, 22 bp, Artificial Sequence
  Primer
acccatgtgtgtcagctcttgg

SEQ ID NO: 4851 - DNA, 22 bp, Artificial Sequence
  Primer
tagcctgtcagaagctgatcac

SEQ ID NO: 4852 - DNA, 22 bp, Artificial Sequence
  Primer
agatgacctattgccaggtaaa

SEQ ID NO: 4853 - DNA, 22 bp, Artificial Sequence
  Primer
gcactgttttataactggattg

SEQ ID NO: 4854 - DNA, 22 bp, Artificial Sequence
  Primer
ccctggcgttgcaggaattctt

SEQ ID NO: 4855 - DNA, 22 bp, Artificial Sequence
  Primer
gaatggggagaaagggcaaagg

SEQ ID NO: 4856 - DNA, 22 bp, Artificial Sequence
  Primer
tctttcatctcctaatgggcac

SEQ ID NO: 4857 - DNA, 22 bp, Artificial Sequence
  Primer
acagacaccttgggtcatgact

SEQ ID NO: 4858 - DNA, 22 bp, Artificial Sequence
  Primer
cagtggtccctctctcatgagt

SEQ ID NO: 4859 - DNA, 22 bp, Artificial Sequence
  Primer
acatgatgcaccccttaccgtt

SEQ ID NO: 4860 - DNA, 22 bp, Artificial Sequence
  Primer
acatgggctcacaggaagatct

SEQ ID NO: 4861 - DNA, 22 bp, Artificial Sequence
  Primer
aagagaagtcggagactgtgtc

SEQ ID NO: 4862 - DNA, 22 bp, Artificial Sequence
  Primer
ccactcaacccacaatctagtc

SEQ ID NO: 4863 - DNA, 22 bp, Artificial Sequence
  Primer
ccaccaaatggatctgttgact

SEQ ID NO: 4864 - DNA, 22 bp, Artificial Sequence
  Primer
aggccggtttcttactacagaa

SEQ ID NO: 4865 - DNA, 22 bp, Artificial Sequence
  Primer
acagaaaggccgtgggtagaga

SEQ ID NO: 4866 - DNA, 22 bp, Artificial Sequence
  Primer
cacatcgctgcttgacagaact

SEQ ID NO: 4867 - DNA, 22 bp, Artificial Sequence
  Primer
cacatttctgagacacttgcta

SEQ ID NO: 4868 - DNA, 22 bp, Artificial Sequence
  Primer
atgagtctctccaccgaatgtg

SEQ ID NO: 4869 - DNA, 22 bp, Artificial Sequence
  Primer
tcatcagttctaggagctttca

SEQ ID NO: 4870 - DNA, 22 bp, Artificial Sequence
  Primer
ggatcgcacagtcactcttcat

SEQ ID NO: 4871 - DNA, 22 bp, Artificial Sequence
  Primer
gattagtgtatggtagaggaca

SEQ ID NO: 4872 - DNA, 22 bp, Artificial Sequence
  Primer
ttggtgtgaatcaagcatcagg

SEQ ID NO: 4873 - DNA, 22 bp, Artificial Sequence
  Primer
gtggattaaaccgaggtggaat

SEQ ID NO: 4874 - DNA, 22 bp, Artificial Sequence
  Primer
ggcattcttgctgctgcttctg

SEQ ID NO: 4875 - DNA, 22 bp, Artificial Sequence
  Primer
atcctgggcaagggagtttcag

SEQ ID NO: 4876 - DNA, 22 bp, Artificial Sequence
  Primer
ttgttcacatcgctgcttgaca

SEQ ID NO: 4877 - DNA, 22 bp, Artificial Sequence
  Primer
gcttgaactgcactcagcagga

SEQ ID NO: 4878 - DNA, 22 bp, Artificial Sequence
  Primer
tctctcaagccactttctatgt

SEQ ID NO: 4879 - DNA, 22 bp, Artificial Sequence
  Primer
actgtggctgcacatagggata

SEQ ID NO: 4880 - DNA, 22 bp, Artificial Sequence
  Primer
ggacccaccctgtcaatttcat

SEQ ID NO: 4881 - DNA, 22 bp, Artificial Sequence
  Primer
tgtttggatatggtggctacta

SEQ ID NO: 4882 - DNA, 22 bp, Artificial Sequence
  Primer
atctctgggaagctctacagtg

SEQ ID NO: 4883 - DNA, 22 bp, Artificial Sequence
  Primer
agataatgggttgcttgggctc

SEQ ID NO: 4884 - DNA, 22 bp, Artificial Sequence
  Primer
gctcgttaagagttcctttgcc

SEQ ID NO: 4885 - DNA, 22 bp, Artificial Sequence
  Primer
tgggtacatgcactgtgcccat

SEQ ID NO: 4886 - DNA, 22 bp, Artificial Sequence
  Primer
ggaactggatgtaaagtcatga

SEQ ID NO: 4887 - DNA, 22 bp, Artificial Sequence
  Primer
ctgcttctagaacaactcatga

SEQ ID NO: 4888 - DNA, 22 bp, Artificial Sequence
  Primer
ccgtctgtgtccagaacggtaa

SEQ ID NO: 4889 - DNA, 22 bp, Artificial Sequence
  Primer
cacgacttaggaggagatcttc

SEQ ID NO: 4890 - DNA, 22 bp, Artificial Sequence
  Primer
tagcaagtcttatcgacacagt

SEQ ID NO: 4891 - DNA, 22 bp, Artificial Sequence
  Primer
gaatacagggatgggactagat

SEQ ID NO: 4892 - DNA, 22 bp, Artificial Sequence
  Primer
atcagaggtctgtaagtcaaca

SEQ ID NO: 4893 - DNA, 22 bp, Artificial Sequence
  Primer
tcgaaacagctgccttctgtag

SEQ ID NO: 4894 - DNA, 22 bp, Artificial Sequence
  Primer
ttcctccattcacgtctctacc

SEQ ID NO: 4895 - DNA, 22 bp, Artificial Sequence
  Primer
gggtcatgtgactgagttctgt

SEQ ID NO: 4896 - DNA, 22 bp, Artificial Sequence
  Primer
taatacctggcatgtagcaagt

SEQ ID NO: 4897 - DNA, 22 bp, Artificial Sequence
  Primer
gaacctcagtcctgcacattcg

SEQ ID NO: 4898 - DNA, 22 bp, Artificial Sequence
  Primer
gtaagtactcctcctgaaagct

SEQ ID NO: 4899 - DNA, 22 bp, Artificial Sequence
  Primer
tgcaaggcgatatgatgaagag

SEQ ID NO: 4900 - DNA, 22 bp, Artificial Sequence
  Primer
tggtgcaggattgttgtcctct

SEQ ID NO: 4901 - DNA, 22 bp, Artificial Sequence
  Primer
tgagcacaggagttcctgatgc

SEQ ID NO: 4902 - DNA, 22 bp, Artificial Sequence
  Primer
cctttccagtttgaattccacc

SEQ ID NO: 4903 - DNA, 22 bp, Artificial Sequence
  Primer
gaatactgcagaagcagaagca

SEQ ID NO: 4904 - DNA, 22 bp, Artificial Sequence
  Primer
ctgagccacaccttctgaaact

SEQ ID NO: 4905 - DNA, 22 bp, Artificial Sequence
  Primer
atgtgactgagttctgtcaagc

SEQ ID NO: 4906 - DNA, 22 bp, Artificial Sequence
  Primer
gtgcttctaacttctcctgctg

SEQ ID NO: 4907 - DNA, 22 bp, Artificial Sequence
  Primer
acgtgaatcacggaacatagaa

SEQ ID NO: 4908 - DNA, 22 bp, Artificial Sequence
  Primer
aaagcttcctggggtatcccta

SEQ ID NO: 4909 - DNA, 22 bp, Artificial Sequence
  Primer
ggggcgatgggaatatgaaatt

SEQ ID NO: 4910 - DNA, 22 bp, Artificial Sequence
  Primer
tgtgtgttttgagttagtagcc

SEQ ID NO: 4911 - DNA, 22 bp, Artificial Sequence
  Primer
ctcaaatcccctcccactgtag

SEQ ID NO: 4912 - DNA, 22 bp, Artificial Sequence
  Primer
gttaaagcagttatgagcccaa

SEQ ID NO: 4913 - DNA, 22 bp, Artificial Sequence
  Primer
cttggactcaagacatcctctg

SEQ ID NO: 4914 - DNA, 22 bp, Artificial Sequence
  Primer
tttcagtgactgctcttccgtt

SEQ ID NO: 4915 - DNA, 22 bp, Artificial Sequence
  Primer
cattagaagcccaggaggaaac

SEQ ID NO: 4916 - DNA, 22 bp, Artificial Sequence
  Primer
ctatgttgcataggagtagtga

SEQ ID NO: 4917 - DNA, 22 bp, Artificial Sequence
  Primer
ccctctataacattttctccca

SEQ ID NO: 4918 - DNA, 22 bp, Artificial Sequence
  Primer
gagccctgctcagaatttcatg

SEQ ID NO: 4919 - DNA, 22 bp, Artificial Sequence
  Primer
gcagccttactgagctgacagt

SEQ ID NO: 4920 - DNA, 22 bp, Artificial Sequence
  Primer
ctccacctggatgggtcaactt

SEQ ID NO: 4921 - DNA, 22 bp, Artificial Sequence
  Primer
catgatctcaataattgcaact

SEQ ID NO: 4922 - DNA, 22 bp, Artificial Sequence
  Primer
atgggtatcactatgcatagca

SEQ ID NO: 4923 - DNA, 22 bp, Artificial Sequence
  Primer
gtgtcctggtgaacggctctga

SEQ ID NO: 4924 - DNA, 22 bp, Artificial Sequence
  Primer
acattcccagctctacattcta

SEQ ID NO: 4925 - DNA, 22 bp, Artificial Sequence
  Primer
gattaagagagggtaggagggt

SEQ ID NO: 4926 - DNA, 22 bp, Artificial Sequence
  Primer
ggattaatagtaccaccccctg

SEQ ID NO: 4927 - DNA, 22 bp, Artificial Sequence
  Primer
gacattccatgcaaatggacac

SEQ ID NO: 4928 - DNA, 22 bp, Artificial Sequence
  Primer
catatggctaaggctctatcta

SEQ ID NO: 4929 - DNA, 22 bp, Artificial Sequence
  Primer
cagctaggggaagagtgacagg

SEQ ID NO: 4930 - DNA, 22 bp, Artificial Sequence
  Primer
ctagaatttccatgtagtaaga

SEQ ID NO: 4931 - DNA, 22 bp, Artificial Sequence
  Primer
cctgcctgatgagcaaagaata

SEQ ID NO: 4932 - DNA, 22 bp, Artificial Sequence
  Primer
caaccaactatctgctgccttc

SEQ ID NO: 4933 - DNA, 22 bp, Artificial Sequence
  Primer
ggtgtggagagagtggactcta

SEQ ID NO: 4934 - DNA, 22 bp, Artificial Sequence
  Primer
catggcacaggtgatagagtga

SEQ ID NO: 4935 - DNA, 22 bp, Artificial Sequence
  Primer
gctctcatgatttgggcatgct

SEQ ID NO: 4936 - DNA, 22 bp, Artificial Sequence
  Primer
gtgaacaggctaacactgttaa

SEQ ID NO: 4937 - DNA, 22 bp, Artificial Sequence
  Primer
tggaagccacttagaggttgca

SEQ ID NO: 4938 - DNA, 22 bp, Artificial Sequence
  Primer
tctaaagatggggcctcacagt

SEQ ID NO: 4939 - DNA, 22 bp, Artificial Sequence
  Primer
tactttactctgtttcctgtat

SEQ ID NO: 4940 - DNA, 22 bp, Artificial Sequence
  Primer
aggaaagggaaatagaagggaa

SEQ ID NO: 4941 - DNA, 22 bp, Artificial Sequence
  Primer
agtgttagtgggaatgaggagt

SEQ ID NO: 4942 - DNA, 22 bp, Artificial Sequence
  Primer
tgggagactgagaccagaggat

SEQ ID NO: 4943 - DNA, 22 bp, Artificial Sequence
  Primer
tggctgtaagtgaaaacggaag

SEQ ID NO: 4944 - DNA, 22 bp, Artificial Sequence
  Primer
ctccttcttcccgagtttcctc

SEQ ID NO: 4945 - DNA, 22 bp, Artificial Sequence
  Primer
aaggataccctctctcactact

SEQ ID NO: 4946 - DNA, 22 bp, Artificial Sequence
  Primer
cttaggacaacccctgggagaa

SEQ ID NO: 4947 - DNA, 22 bp, Artificial Sequence
  Primer
gaggcaaggtctttcatgaaat

SEQ ID NO: 4948 - DNA, 22 bp, Artificial Sequence
  Primer
ccgtccatgggaacactgtcag

SEQ ID NO: 4949 - DNA, 22 bp, Artificial Sequence
  Primer
attaagttccttgaaagttgac

SEQ ID NO: 4950 - DNA, 22 bp, Artificial Sequence
  Primer
gaagaaaacaggagagttgcaa

SEQ ID NO: 4951 - DNA, 22 bp, Artificial Sequence
  Primer
tttaaaattccacttgctatgc

SEQ ID NO: 4952 - DNA, 22 bp, Artificial Sequence
  Primer
aatcagagtttccttcagagcc

SEQ ID NO: 4953 - DNA, 22 bp, Artificial Sequence
  Primer
ctgagtttcctcactagaatgt

SEQ ID NO: 4954 - DNA, 22 bp, Artificial Sequence
  Primer
accttccaaccatcaccctcct

SEQ ID NO: 4955 - DNA, 22 bp, Artificial Sequence
  Primer
atttaacacaaaggcagggggt

SEQ ID NO: 4956 - DNA, 22 bp, Artificial Sequence
  Primer
cccgcttgcttttggtgtccat

SEQ ID NO: 4957 - DNA, 22 bp, Artificial Sequence
  Primer
aatcagcaggtacatagataga

SEQ ID NO: 4958 - DNA, 22 bp, Artificial Sequence
  Primer
cgaaatgccgactgcctgtcac

SEQ ID NO: 4959 - DNA, 22 bp, Artificial Sequence
  Primer
atacttgctctttctcttacta

SEQ ID NO: 4960 - DNA, 22 bp, Artificial Sequence
  Primer
cactgggtacttcttattcttt

SEQ ID NO: 4961 - DNA, 22 bp, Artificial Sequence
  Primer
taggtgagtctcttgaaggcag

SEQ ID NO: 4962 - DNA, 22 bp, Artificial Sequence
  Primer
taatataaaatccttagagtcc

SEQ ID NO: 4963 - DNA, 22 bp, Artificial Sequence
  Primer
ataatccaggaagatcactcta

SEQ ID NO: 4964 - DNA, 22 bp, Artificial Sequence
  Primer
gttcaaatcttgcaagcatgcc

SEQ ID NO: 4965 - DNA, 22 bp, Artificial Sequence
  Primer
atgcgtgctggtgtttaacagt

SEQ ID NO: 4966 - DNA, 22 bp, Artificial Sequence
  Primer
aacagtttggtacatgcaacct

SEQ ID NO: 4967 - DNA, 22 bp, Artificial Sequence
  Primer
atggcttcagttttactgtgag

SEQ ID NO: 4968 - DNA, 22 bp, Artificial Sequence
  Primer
aagtgatatgagacatacagga

SEQ ID NO: 4969 - DNA, 22 bp, Artificial Sequence
  Primer
tatctgcgtggtggttcccttc

SEQ ID NO: 4970 - DNA, 22 bp, Artificial Sequence
  Primer
ctccattatcagtcactcctca

SEQ ID NO: 4971 - DNA, 22 bp, Artificial Sequence
  Primer
gaaacccacatcagcacaaagg

SEQ ID NO: 4972 - DNA, 22 bp, Artificial Sequence
  Primer
cgccgaattccatgactcttga

SEQ ID NO: 4973 - DNA, 22 bp, Artificial Sequence
  Primer
cacaaagacagacccacagctc

SEQ ID NO: 4974 - DNA, 22 bp, Artificial Sequence
  Primer
ccacacaggaaaactgccatct

SEQ ID NO: 4975 - DNA, 22 bp, Artificial Sequence
  Primer
gagacgtgagtcaggacaggtg

SEQ ID NO: 4976 - DNA, 22 bp, Artificial Sequence
  Primer
gatgccaggaagtacctggtaa

SEQ ID NO: 4977 - DNA, 22 bp, Artificial Sequence
  Primer
ggaaacccgtgacttgacttag

SEQ ID NO: 4978 - DNA, 22 bp, Artificial Sequence
  Primer
aggtggtgatctagtctccggt

SEQ ID NO: 4979 - DNA, 24 bp, Artificial Sequence
  Primer
aaccagacagcatctctggagaga

SEQ ID NO: 4980 - DNA, 22 bp, Artificial Sequence
  Primer
atgcatacagcaggccattgtg

SEQ ID NO: 4981 - DNA, 22 bp, Artificial Sequence
  Primer
gggagctacaggtgatagctat

SEQ ID NO: 4982 - DNA, 22 bp, Artificial Sequence
  Primer
caccagagaccagagactcgaa

SEQ ID NO: 4983 - DNA, 22 bp, Artificial Sequence
  Primer
tgagcagtctgacctgcttctc

SEQ ID NO: 4984 - DNA, 22 bp, Artificial Sequence
  Primer
cagccagctactgaaccttatg

SEQ ID NO: 4985 - DNA, 22 bp, Artificial Sequence
  Primer
taccaccaccctgcgcagatgg

SEQ ID NO: 4986 - DNA, 22 bp, Artificial Sequence
  Primer
ggcacacagtctgcaatgcttg

SEQ ID NO: 4987 - DNA, 22 bp, Artificial Sequence
  Primer
tgttctggcagattccatcatc

SEQ ID NO: 4988 - DNA, 22 bp, Artificial Sequence
  Primer
cagggtcattcgaggaggaaca

SEQ ID NO: 4989 - DNA, 22 bp, Artificial Sequence
  Primer
gatgcaagcagcacagagcagt

SEQ ID NO: 4990 - DNA, 22 bp, Artificial Sequence
  Primer
tctctaccaggcaatacttcac

SEQ ID NO: 4991 - DNA, 22 bp, Artificial Sequence
  Primer
aaaggccacacagcccacaatc

SEQ ID NO: 4992 - DNA, 22 bp, Artificial Sequence
  Primer
aagtctgacttcaaatcggtac

SEQ ID NO: 4993 - DNA, 22 bp, Artificial Sequence
  Primer
aagtctgacttcaaatcggtac

SEQ ID NO: 4994 - DNA, 22 bp, Artificial Sequence
  Primer
aagtcaattgctccccatctgc

SEQ ID NO: 4995 - DNA, 22 bp, Artificial Sequence
  Primer
gactcatatgacagaccttgaa

SEQ ID NO: 4996 - DNA, 22 bp, Artificial Sequence
  Primer
catgactcccagaccccttaga

SEQ ID NO: 4997 - DNA, 22 bp, Artificial Sequence
  Primer
caaacggagaagccccagatac

SEQ ID NO: 4998 - DNA, 22 bp, Artificial Sequence
  Primer
agtgacaattagagctctgggg

SEQ ID NO: 4999 - DNA, 22 bp, Artificial Sequence
  Primer
tgcttggccaaacagacttcct

SEQ ID NO: 5000 - DNA, 22 bp, Artificial Sequence
  Primer
tttgtgctggctggcctttgtg

SEQ ID NO: 5001 - DNA, 22 bp, Artificial Sequence
  Primer
tttggcagaatgtttcaagagt

SEQ ID NO: 5002 - DNA, 22 bp, Artificial Sequence
  Primer
gctgtgggaaatgtgagctgtg

SEQ ID NO: 5003 - DNA, 22 bp, Artificial Sequence
  Primer
ccaattctcctttcagatggca

SEQ ID NO: 5004 - DNA, 22 bp, Artificial Sequence
  Primer
tgcccaatctgtaccacctgtc

SEQ ID NO: 5005 - DNA, 22 bp, Artificial Sequence
  Primer
gcaatctccaatccttaccagg

SEQ ID NO: 5006 - DNA, 22 bp, Artificial Sequence
  Primer
tgtcatcagcacccctaagtca

SEQ ID NO: 5007 - DNA, 22 bp, Artificial Sequence
  Primer
gagtgaaaggtggaaccggaga

SEQ ID NO: 5008 - DNA, 24 bp, Artificial Sequence
  Primer
cacagagagtgcattttctctcca

SEQ ID NO: 5009 - DNA, 22 bp, Artificial Sequence
  Primer
cagccccctatgaccacaatgg

SEQ ID NO: 5010 - DNA, 22 bp, Artificial Sequence
  Primer
gggcgcatagctatcacctgta

SEQ ID NO: 5011 - DNA, 22 bp, Artificial Sequence
  Primer
accatggacaggccttcgagtc

SEQ ID NO: 5012 - DNA, 22 bp, Artificial Sequence
  Primer
agctggagcacctggagaagca

SEQ ID NO: 5013 - DNA, 22 bp, Artificial Sequence
  Primer
tggccctaggcacacataaggt

SEQ ID NO: 5014 - DNA, 22 bp, Artificial Sequence
  Primer
  modified_base (4): a, t, c or g
gtantctgtggccgccatctgc

SEQ ID NO: 5015 - DNA, 22 bp, Artificial Sequence
  Primer
taggggacatccctcaagcatt

SEQ ID NO: 5016 - DNA, 22 bp, Artificial Sequence
  Primer
cttatgttgggattgatgatgg

SEQ ID NO: 5017 - DNA, 22 bp, Artificial Sequence
  Primer
cgaaagcttgaatctgttcctc

SEQ ID NO: 5018 - DNA, 22 bp, Artificial Sequence
  Primer
ctccttcccacagcactgctct

SEQ ID NO: 5019 - DNA, 22 bp, Artificial Sequence
  Primer
ctgaaatcgagtgagtgaagta

SEQ ID NO: 5020 - DNA, 22 bp, Artificial Sequence
  Primer
ggcctgcagtggatgattgtgg

SEQ ID NO: 5021 - DNA, 22 bp, Artificial Sequence
  Primer
tgtctaagcctcatgtaccgat

SEQ ID NO: 5022 - DNA, 22 bp, Artificial Sequence
  Primer
tgtctaagcctcatgtaccgat

SEQ ID NO: 5023 - DNA, 22 bp, Artificial Sequence
  Primer
cttgttcgttgctggcagatgg

SEQ ID NO: 5024 - DNA, 22 bp, Artificial Sequence
  Primer
tgtcccacctttccttcaaggt

SEQ ID NO: 5025 - DNA, 22 bp, Artificial Sequence
  Primer
tgcccaaattcctgtctaaggg

SEQ ID NO: 5026 - DNA, 22 bp, Artificial Sequence
  Primer
ttgttactgtacgtgtatctgg

SEQ ID NO: 5027 - DNA, 22 bp, Artificial Sequence
  Primer
gctccttcattctcccccagag

SEQ ID NO: 5028 - DNA, 22 bp, Artificial Sequence
  Primer
tgatgagactgcagaggaagtc

SEQ ID NO: 5029 - DNA, 22 bp, Artificial Sequence
  Primer
acctgagagcagggagattcca

SEQ ID NO: 5030 - DNA, 22 bp, Artificial Sequence
  Primer
cccgaggcttctctgaacacta

SEQ ID NO: 5031 - DNA, 22 bp, Artificial Sequence
  Primer
aatctgaggcacacaggagagt

SEQ ID NO: 5032 - DNA, 22 bp, Artificial Sequence
  Primer
gccttgctaactgtaccatagt

SEQ ID NO: 5033 - DNA, 22 bp, Artificial Sequence
  Primer
tctaaggttccggatggacgtg

SEQ ID NO: 5034 - DNA, 22 bp, Artificial Sequence
  Primer
gagttacaggaagtggttcccc

SEQ ID NO: 5035 - DNA, 22 bp, Artificial Sequence
  Primer
acagctctccttccttaatgcc

SEQ ID NO: 5036 - DNA, 24 bp, Artificial Sequence
  Primer
agactgcatccttcgaacaacagg

SEQ ID NO: 5037 - DNA, 24 bp, Artificial Sequence
  Primer
ttctcgagggttctctgcttcact

SEQ ID NO: 5038 - DNA, 24 bp, Artificial Sequence
  Primer
gaaaaacccgcaccctgacacaac

SEQ ID NO: 5039 - DNA, 24 bp, Artificial Sequence
  Primer
cagcacatcgagtcctcaaatccg

SEQ ID NO: 5040 - DNA, 24 bp, Artificial Sequence
  Primer
tcgagaaaggctgttcctacaagg

SEQ ID NO: 5041 - DNA, 24 bp, Artificial Sequence
  Primer
aagctgctcttctcagctactctg

SEQ ID NO: 5042 - DNA, 24 bp, Artificial Sequence
  Primer
caaagcactggactgagagaattc

SEQ ID NO: 5043 - DNA, 24 bp, Artificial Sequence
  Primer
taaaggcaaaggccacacagccca

SEQ ID NO: 5044 - DNA, 24 bp, Artificial Sequence
  Primer
taaagataaggcgtgggctttgac

SEQ ID NO: 5045 - DNA, 24 bp, Artificial Sequence
  Primer
tcataccaagtgctggctgctaag

SEQ ID NO: 5046 - DNA, 24 bp, Artificial Sequence
  Primer
ctctaagaaccagaccctcagttg

SEQ ID NO: 5047 - DNA, 24 bp, Artificial Sequence
  Primer
ggtttgaacagtgggagataccag

SEQ ID NO: 5048 - DNA, 24 bp, Artificial Sequence
  Primer
caaacacaagaggtcctcttgctg

SEQ ID NO: 5049 - DNA, 24 bp, Artificial Sequence
  Primer
gtgccctgtgaaattggcctttct

SEQ ID NO: 5050 - DNA, 24 bp, Artificial Sequence
  Primer
ggaaggctgtcttctttctaccac

SEQ ID NO: 5051 - DNA, 24 bp, Artificial Sequence
  Primer
caaacacaagaggtcctcttgctg

SEQ ID NO: 5052 - DNA, 24 bp, Artificial Sequence
  Primer
gcatgtgttgtttctgtctgggat

SEQ ID NO: 5053 - DNA, 24 bp, Artificial Sequence
  Primer
gtgccctgtgaaattggcctttct

SEQ ID NO: 5054 - DNA, 24 bp, Artificial Sequence
  Primer
gcatgtgttgtttctgtctgggat

SEQ ID NO: 5055 - DNA, 24 bp, Artificial Sequence
  Primer
acagactacaacgtcaatgaagcc

SEQ ID NO: 5056 - DNA, 24 bp, Artificial Sequence
  Primer
tcttctctctcactgcagaccatg

SEQ ID NO: 5057 - DNA, 24 bp, Artificial Sequence
  Primer
gctagtggaacggatacctgaaag

SEQ ID NO: 5058 - DNA, 22 bp, Artificial Sequence
  Primer
taactcctagcagctggaatct

SEQ ID NO: 5059 - DNA, 22 bp, Artificial Sequence
  Primer
ctcacagcgctttctagtgttc

SEQ ID NO: 5060 - DNA, 22 bp, Artificial Sequence
  Primer
actgagctcctttcactctcct

SEQ ID NO: 5061 - DNA, 22 bp, Artificial Sequence
  Primer
cacctgcaggaataactatggt

SEQ ID NO: 5062 - DNA, 22 bp, Artificial Sequence
  Primer
tgtcccgccaaattcacgtcca

SEQ ID NO: 5063 - DNA, 22 bp, Artificial Sequence
  Primer
ctgcgtgtctgtcaggggaacc

SEQ ID NO: 5064 - DNA, 22 bp, Artificial Sequence
  Primer
cacccttatctctgggcattaa

SEQ ID NO: 5065 - DNA, 24 bp, Artificial Sequence
  Primer
actgggaaatctagcgcctgttgt

SEQ ID NO: 5066 - DNA, 24 bp, Artificial Sequence
  Primer
agttctctcgggagttagtgaagc

SEQ ID NO: 5067 - DNA, 24 bp, Artificial Sequence
  Primer
cgtccagaaaacgtaggttgtgtc

SEQ ID NO: 5068 - DNA, 24 bp, Artificial Sequence
  Primer
ccagactttcctcactcggatttg

SEQ ID NO: 5069 - DNA, 24 bp, Artificial Sequence
  Primer
taacctcaggaccttcccttgtag

SEQ ID NO: 5070 - DNA, 24 bp, Artificial Sequence
  Primer
tttcagggttctgggtcagagtag

SEQ ID NO: 5071 - DNA, 24 bp, Artificial Sequence
  Primer
ggtggatacagtgtgtgaattctc

SEQ ID NO: 5072 - DNA, 24 bp, Artificial Sequence
  Primer
ctgcagtggatgattgtgggctgt

SEQ ID NO: 5073 - DNA, 24 bp, Artificial Sequence
  Primer
aactctggcagacactgtcaaagc

SEQ ID NO: 5074 - DNA, 24 bp, Artificial Sequence
  Primer
ccagtttctccacatccttagcag

SEQ ID NO: 5075 - DNA, 24 bp, Artificial Sequence
  Primer
ctcattcccttactggcaactgag

SEQ ID NO: 5076 - DNA, 24 bp, Artificial Sequence
  Primer
ttttctcctcccacctctggtatc

SEQ ID NO: 5077 - DNA, 24 bp, Artificial Sequence
  Primer
acagtccatggaaaggcagcaaga

SEQ ID NO: 5078 - DNA, 24 bp, Artificial Sequence
  Primer
gctggaagcagaaagaagaaaggc

SEQ ID NO: 5079 - DNA, 24 bp, Artificial Sequence
  Primer
tgacacctgcctcatggtggtaga

SEQ ID NO: 5080 - DNA, 24 bp, Artificial Sequence
  Primer
acagtccatggaaaggcagcaaga

SEQ ID NO: 5081 - DNA, 24 bp, Artificial Sequence
  Primer
agcagacaagatctagatcccaga

SEQ ID NO: 5082 - DNA, 24 bp, Artificial Sequence
  Primer
gctggaagcagaaagaagaaaggc

SEQ ID NO: 5083 - DNA, 24 bp, Artificial Sequence
  Primer
agcagacaagatctagatcccaga

SEQ ID NO: 5084 - DNA, 24 bp, Artificial Sequence
  Primer
tccgacaatgccaggaggcttcat

SEQ ID NO: 5085 - DNA, 24 bp, Artificial Sequence
  Primer
tgcccacatggagaaacatggtct

SEQ ID NO: 5086 - DNA, 24 bp, Artificial Sequence
  Primer
cttcctgtggtagtgtctttcagg

SEQ ID NO: 5087 - DNA, 24 bp, Artificial Sequence
  Primer
ctcaatccacatgacaacgctttg

SEQ ID NO: 5088 - DNA, 24 bp, Artificial Sequence
  Primer
ggcaaaagggaaaaaccatgtatg

SEQ ID NO: 5089 - DNA, 24 bp, Artificial Sequence
  Primer
aatagattgattgccgtcctcaac

SEQ ID NO: 5090 - DNA, 24 bp, Artificial Sequence
  Primer
agatgggggagacaaacggtaaac

SEQ ID NO: 5091 - DNA, 24 bp, Artificial Sequence
  Primer
tttgttggtcagctggtccaacca

SEQ ID NO: 5092 - DNA, 24 bp, Artificial Sequence
  Primer
ccgtattacccagactacacactg

SEQ ID NO: 5093 - DNA, 24 bp, Artificial Sequence
  Primer
ccagcagcaggatattgtgtacgt

SEQ ID NO: 5094 - DNA, 24 bp, Artificial Sequence
  Primer
ttcttcttcaggtcccgctcaaag

SEQ ID NO: 5095 - DNA, 24 bp, Artificial Sequence
  Primer
aactgggatgccaactaacacgtg

SEQ ID NO: 5096 - DNA, 24 bp, Artificial Sequence
  Primer
aaccccacctatggttgtagtgag

SEQ ID NO: 5097 - DNA, 24 bp, Artificial Sequence
  Primer
gaggctaggctgaatataaccagg

SEQ ID NO: 5098 - DNA, 24 bp, Artificial Sequence
  Primer
ccactggctgcattttccagcttt

SEQ ID NO: 5099 - DNA, 24 bp, Artificial Sequence
  Primer
cggcacaagcagatttcagatcag

SEQ ID NO: 5100 - DNA, 24 bp, Artificial Sequence
  Primer
aactggagtcaggtgatcacgaag

SEQ ID NO: 5101 - DNA, 24 bp, Artificial Sequence
  Primer
aagtcaattgctccccatctgcca

SEQ ID NO: 5102 - DNA, 24 bp, Artificial Sequence
  Primer
ctgagttccttagcagcttccgta

SEQ ID NO: 5103 - DNA, 24 bp, Artificial Sequence
  Primer
ggaggtgaataagctgatcctgca

SEQ ID NO: 5104 - DNA, 24 bp, Artificial Sequence
  Primer
ggacacatctgttccatcttcacc

SEQ ID NO: 5105 - DNA, 22 bp, Artificial Sequence
  Primer
tgatcctcactgtggaacccct

SEQ ID NO: 5106 - DNA, 22 bp, Artificial Sequence
  Primer
agagcggctcttttaatgaggg

SEQ ID NO: 5107 - DNA, 22 bp, Artificial Sequence
  Primer
tcagtccataggatgatgtcag

SEQ ID NO: 5108 - DNA, 22 bp, Artificial Sequence
  Primer
cccagcaaagatcaacctctgc

SEQ ID NO: 5109 - DNA, 22 bp, Artificial Sequence
  Primer
atgtgggaaggcctttggtagt

SEQ ID NO: 5110 - DNA, 22 bp, Artificial Sequence
  Primer
gtgaatgtggaaaagccttcac

SEQ ID NO: 5111 - DNA, 22 bp, Artificial Sequence
  Primer
gttgcaagtgttctcacccaag

SEQ ID NO: 5112 - DNA, 22 bp, Artificial Sequence
  Primer
gaacgacgtgtgtaaatgacag

SEQ ID NO: 5113 - DNA, 22 bp, Artificial Sequence
  Primer
ccttcaggcatcccacagatga

SEQ ID NO: 5114 - DNA, 24 bp, Artificial Sequence
  Primer
acctagtatcctacctcaaagcgt

SEQ ID NO: 5115 - DNA, 24 bp, Artificial Sequence
  Primer
tcacttcccttacagtcatacatg

SEQ ID NO: 5116 - DNA, 24 bp, Artificial Sequence
  Primer
aagtatgtgctaacttgttgagga

SEQ ID NO: 5117 - DNA, 24 bp, Artificial Sequence
  Primer
cggaaaggaaacatctgtttaccg

SEQ ID NO: 5118 - DNA, 24 bp, Artificial Sequence
  Primer
tgcagtaatggatgggtggttgga

SEQ ID NO: 5119 - DNA, 24 bp, Artificial Sequence
  Primer
caccaatggcatagcacagtgtgt

SEQ ID NO: 5120 - DNA, 24 bp, Artificial Sequence
  Primer
gtttacagcctacaggacgtacac

SEQ ID NO: 5121 - DNA, 24 bp, Artificial Sequence
  Primer
tcacggcctacgagatctttgagc

SEQ ID NO: 5122 - DNA, 24 bp, Artificial Sequence
  Primer
aagtcttggggaactccacgtgtt

SEQ ID NO: 5123 - DNA, 24 bp, Artificial Sequence
  Primer
ggcgtaaagtaggatgctcactac

SEQ ID NO: 5124 - DNA, 24 bp, Artificial Sequence
  Primer
cactgccagtcagcaacctggtta

SEQ ID NO: 5125 - DNA, 24 bp, Artificial Sequence
  Primer
caccaggtactagagaaaagctgg

SEQ ID NO: 5126 - DNA, 24 bp, Artificial Sequence
  Primer
ctgggggaaatgctgactgatctg

SEQ ID NO: 5127 - DNA, 24 bp, Artificial Sequence
  Primer
ccagtgaaataagccccttcgtga

SEQ ID NO: 5128 - DNA, 24 bp, Artificial Sequence
  Primer
tctacttgttcgttgctggcagat

SEQ ID NO: 5129 - DNA, 24 bp, Artificial Sequence
  Primer
tcttcaaaggacctcctacggaag

SEQ ID NO: 5130 - DNA, 24 bp, Artificial Sequence
  Primer
gctgggtaactagaagtgcaggat

SEQ ID NO: 5131 - DNA, 24 bp, Artificial Sequence
  Primer
cccatgagttgttagtggtgaaga

SEQ ID NO: 5132 - DNA, 22 bp, Artificial Sequence
  Primer
gagagagtccattgaggggttc

SEQ ID NO: 5133 - DNA, 22 bp, Artificial Sequence
  Primer
gggagacgtcgcaaccctcatt

SEQ ID NO: 5134 - DNA, 22 bp, Artificial Sequence
  Primer
tcctccagcctaaactgacatc

SEQ ID NO: 5135 - DNA, 22 bp, Artificial Sequence
  Primer
atccctcctgatcagcagaggt

SEQ ID NO: 5136 - DNA, 22 bp, Artificial Sequence
  Primer
gtaaggtttgagccactaccaa

SEQ ID NO: 5137 - DNA, 22 bp, Artificial Sequence
  Primer
gagatgacttctgagtgaaggc

SEQ ID NO: 5138 - DNA, 22 bp, Artificial Sequence
  Primer
aaccatacttccaccttgggtg

SEQ ID NO: 5139 - DNA, 22 bp, Artificial Sequence
  Primer
agggtggtggtattctgtcatt

SEQ ID NO: 5140 - DNA, 22 bp, Artificial Sequence
  Primer
cggaacatgtgccttcatctgt

SEQ ID NO: 5141 - DNA, 24 bp, Artificial Sequence
  Primer
tcaggcaccaaatctgaacaaggg

SEQ ID NO: 5142 - DNA, 24 bp, Artificial Sequence
  Primer
gccatcaaggtgatgaggaagaag

SEQ ID NO: 5143 - DNA, 24 bp, Artificial Sequence
  Primer
gtgctgaatctcttgcgtgacatg

SEQ ID NO: 5144 - DNA, 24 bp, Artificial Sequence
  Primer
tggttctctgcttcactggcagaa

SEQ ID NO: 5145 - DNA, 22 bp, Artificial Sequence
  Primer
gagcacatctggcctggccagt

SEQ ID NO: 5146 - DNA, 24 bp, Artificial Sequence
  Primer
agtgagctcagaacacctcacacc

SEQ ID NO: 5147 - DNA, 24 bp, Artificial Sequence
  Primer
acttctgcagtcatcgagaagtcc

SEQ ID NO: 5148 - DNA, 24 bp, Artificial Sequence
  Primer
tctccagtatgagtcctctggtgt

SEQ ID NO: 5149 - DNA, 22 bp, Artificial Sequence
  Primer
atccaccgctagaaacccactc

SEQ ID NO: 5150 - DNA, 22 bp, Artificial Sequence
  Primer
cctagtagctttcctcccaaag

SEQ ID NO: 5151 - DNA, 22 bp, Artificial Sequence
  Primer
agaggagctgtctaaggccatc

SEQ ID NO: 5152 - DNA, 22 bp, Artificial Sequence
  Primer
cagtacatgtttacccacagac

SEQ ID NO: 5153 - DNA, 24 bp, Artificial Sequence
  Primer
agaaagcctctcttcccctctctc

SEQ ID NO: 5154 - DNA, 22 bp, Artificial Sequence
  Primer
tctcaggaaccagagtccatag

SEQ ID NO: 5155 - DNA, 22 bp, Artificial Sequence
  Primer
cagctcaggaagttcaccaggc

SEQ ID NO: 5156 - DNA, 22 bp, Artificial Sequence
  Primer
catttacctgcccgcctggtca

SEQ ID NO: 5157 - DNA, 22 bp, Artificial Sequence
  Primer
ctggatttccagagactgacct

SEQ ID NO: 5158 - DNA, 22 bp, Artificial Sequence
  Primer
acaacagaagttgtcagtgaag

SEQ ID NO: 5159 - DNA, 24 bp, Artificial Sequence
  Primer
cttaagcgagcaacctgataaccc

SEQ ID NO: 5160 - DNA, 24 bp, Artificial Sequence
  Primer
gagaatcagctgccatgttgtgag

SEQ ID NO: 5161 - DNA, 22 bp, Artificial Sequence
  Primer
agcagcactaggcatggctgtt

SEQ ID NO: 5162 - DNA, 24 bp, Artificial Sequence
  Primer
caagcttccctcctttcccattgt

SEQ ID NO: 5163 - DNA, 24 bp, Artificial Sequence
  Primer
agtcaggtacagggttctgacaac

SEQ ID NO: 5164 - DNA, 22 bp, Artificial Sequence
  Primer
caagtgtcccacttttcctgca

SEQ ID NO: 5165 - DNA, 22 bp, Artificial Sequence
  Primer
ccatgttgtgaggatgctcaaa

SEQ ID NO: 5166 - DNA, 22 bp, Artificial Sequence
  Primer
gatctgcagcattgagggagca

SEQ ID NO: 5167 - DNA, 22 bp, Artificial Sequence
  Primer
  modified_base (14): a, t, c or g
ggggatttagtagntcaatgta

SEQ ID NO: 5168 - DNA, 22 bp, Artificial Sequence
  Primer
gtttgtaggcttcttgcctctg

SEQ ID NO: 5169 - DNA, 22 bp, Artificial Sequence
  Primer
gtccaagagtgggcagttgacc

SEQ ID NO: 5170 - DNA, 24 bp, Artificial Sequence
  Primer
gaaggttggatccaagcccttgtt

SEQ ID NO: 5171 - DNA, 24 bp, Artificial Sequence
  Primer
aagaaaatccccgtgacttcttcc

SEQ ID NO: 5172 - DNA, 24 bp, Artificial Sequence
  Primer
tagtgaaccttgggaccatgtcac

SEQ ID NO: 5173 - DNA, 24 bp, Artificial Sequence
  Primer
ggataagcttgtgtggttctgcca

SEQ ID NO: 5174 - DNA, 22 bp, Artificial Sequence
  Primer
tgaggttctgagtcactggcca

SEQ ID NO: 5175 - DNA, 24 bp, Artificial Sequence
  Primer
agttgagtgacgctgtggtgtgag

SEQ ID NO: 5176 - DNA, 24 bp, Artificial Sequence
  Primer
cccacaaaagatcccaggacttct

SEQ ID NO: 5177 - DNA, 24 bp, Artificial Sequence
  Primer
gcttttccctggtgttacaccaga

SEQ ID NO: 5178 - DNA, 22 bp, Artificial Sequence
  Primer
gaccatcaactgatgagtgggt

SEQ ID NO: 5179 - DNA, 22 bp, Artificial Sequence
  Primer
attggaaagaaagcctttggga

SEQ ID NO: 5180 - DNA, 22 bp, Artificial Sequence
  Primer
tgctgcatggctgtgatggcct

SEQ ID NO: 5181 - DNA, 22 bp, Artificial Sequence
  Primer
tgcacataagtcgacagacacc

SEQ ID NO: 5182 - DNA, 24 bp, Artificial Sequence
  Primer
gtcacatttttggggtgagagagg

SEQ ID NO: 5183 - DNA, 22 bp, Artificial Sequence
  Primer
cagttagataaaagctatggac

SEQ ID NO: 5184 - DNA, 22 bp, Artificial Sequence
  Primer
aggacccagttgaagcctggtg

SEQ ID NO: 5185 - DNA, 22 bp, Artificial Sequence
  Primer
caggatttgtgtggtgaccagg

SEQ ID NO: 5186 - DNA, 22 bp, Artificial Sequence
  Primer
tcaggcaatagagaaggtcagt

SEQ ID NO: 5187 - DNA, 22 bp, Artificial Sequence
  Primer
ctgttcaacagtgccttcactg

SEQ ID NO: 5188 - DNA, 24 bp, Artificial Sequence
  Primer
tcctaatctggcaggtgggttatc

SEQ ID NO: 5189 - DNA, 24 bp, Artificial Sequence
  Primer
ggactctttgagcatcctcacaac

SEQ ID NO: 5190 - DNA, 22 bp, Artificial Sequence
  Primer
ataagagctgagataacagcca

SEQ ID NO: 5191 - DNA, 24 bp, Artificial Sequence
  Primer
ttccggcgttgtagttacaatggg

SEQ ID NO: 5192 - DNA, 24 bp, Artificial Sequence
  Primer
caccttgttcgtctctgttgtcag

SEQ ID NO: 5193 - DNA, 22 bp, Artificial Sequence
  Primer
ccgctcactcactctgcaggaa

SEQ ID NO: 5194 - DNA, 22 bp, Artificial Sequence
  Primer
accttttaggactctttgagca

SEQ ID NO: 5195 - DNA, 22 bp, Artificial Sequence
  Primer
gtctctaggcacattgctccct

SEQ ID NO: 5196 - DNA, 22 bp, Artificial Sequence
  Primer
gtcatcgggtgacatacattga

SEQ ID NO: 5197 - DNA, 22 bp, Artificial Sequence
  Primer
ccctctaccattcacagaggca

SEQ ID NO: 5198 - DNA, 22 bp, Artificial Sequence
  Primer
attggataggcataggtcaact

SEQ ID NO: 5199 - DNA, 22 bp, Artificial Sequence
  Primer
tctaactttcgtttgcctgctt

SEQ ID NO: 5200 - DNA, 22 bp, Artificial Sequence
  Primer
gttcgagatccacaggtgtcta

SEQ ID NO: 5201 - DNA, 22 bp, Artificial Sequence
  Primer
tgttgcctaggctggtcttgaa

SEQ ID NO: 5202 - DNA, 22 bp, Artificial Sequence
  Primer
gaccagcctaggcacatagtga

SEQ ID NO: 5203 - DNA, 22 bp, Artificial Sequence
  Primer
aattgtctccatggggctcgaa

SEQ ID NO: 5204 - DNA, 22 bp, Artificial Sequence
  Primer
tactgccactctccagaatatc

SEQ ID NO: 5205 - DNA, 22 bp, Artificial Sequence
  Primer
gtggttgggttaacaaagaatg

SEQ ID NO: 5206 - DNA, 22 bp, Artificial Sequence
  Primer
aaggtagagcttggcaacagga

SEQ ID NO: 5207 - DNA, 22 bp, Artificial Sequence
  Primer
tgccaggagttttaagttggtt

SEQ ID NO: 5208 - DNA, 22 bp, Artificial Sequence
  Primer
gtatggatagcagacgatagag

SEQ ID NO: 5209 - DNA, 24 bp, Artificial Sequence
  Primer
tacattccaccagcagtgcacaag

SEQ ID NO: 5210 - DNA, 24 bp, Artificial Sequence
  Primer
ttgttaggcttctgggttgggtac

SEQ ID NO: 5211 - DNA, 22 bp, Artificial Sequence
  Primer
cttccgtcatgaatgtcagtag

SEQ ID NO: 5212 - DNA, 22 bp, Artificial Sequence
  Primer
tgggaagagttgcctccaggaa

SEQ ID NO: 5213 - DNA, 22 bp, Artificial Sequence
  Primer
ctgtattaaatgagtctgggtt

SEQ ID NO: 5214 - DNA, 22 bp, Artificial Sequence
  Primer
cactgtgctttcagaagcaggc

SEQ ID NO: 5215 - DNA, 22 bp, Artificial Sequence
  Primer
tgtagcatatgatgtagacacc

SEQ ID NO: 5216 - DNA, 22 bp, Artificial Sequence
  Primer
cttgagtccaagagttcaagac

SEQ ID NO: 5217 - DNA, 22 bp, Artificial Sequence
  Primer
ttagagatggggtctcactatg

SEQ ID NO: 5218 - DNA, 22 bp, Artificial Sequence
  Primer
ccttcactgaggagttcgagcc

SEQ ID NO: 5219 - DNA, 22 bp, Artificial Sequence
  Primer
gatctggaaggtcggatattct

SEQ ID NO: 5220 - DNA, 22 bp, Artificial Sequence
  Primer
gagaagctgcaacgcattcttt

SEQ ID NO: 5221 - DNA, 22 bp, Artificial Sequence
  Primer
agccccgctggacctcctgttg

SEQ ID NO: 5222 - DNA, 22 bp, Artificial Sequence
  Primer
gaatggcatttggtaaccaact

SEQ ID NO: 5223 - DNA, 22 bp, Artificial Sequence
  Primer
tctatctgtcatccctctatcg

SEQ ID NO: 5224 - DNA, 24 bp, Artificial Sequence
  Primer
tggagaaattggaagccttgtgca

SEQ ID NO: 5225 - DNA, 24 bp, Artificial Sequence
  Primer
acaggcattagcccctgtacccaa

SEQ ID NO: 5226 - DNA, 22 bp, Artificial Sequence
  Primer
tctgcagtggttccctactgac

SEQ ID NO: 5227 - DNA, 22 bp, Artificial Sequence
  Primer
cccttctcagtcctttcctgga

SEQ ID NO: 5228 - DNA, 22 bp, Artificial Sequence
  Primer
gggttaatacagttaacccaga

SEQ ID NO: 5229 - DNA, 18 bp, Artificial Sequence
  Primer
tgtaggactatattgctc

SEQ ID NO: 5230 - DNA, 18 bp, Artificial Sequence
  Primer
cgacatttaggtgacact

SEQ ID NO: 5231 - DNA, 15 bp, Artificial Sequence
  BstXI-linker adapter
gtcttcaccacgggg

SEQ ID NO: 5232 - DNA, 11 bp, Artificial Sequence
  BstXI-linker adapter
gtggtgaagac

SEQ ID NO: 5233 - DNA, 20 bp, Artificial Sequence
  Synthetic oligonucleotide
ctcgagaattctggatcctc

SEQ ID NO: 5234 - DNA, 22 bp, Artificial Sequence
  Synthetic oligonucleotide
ttgaggatccagaattctcgag

SEQ ID NO: 5235 - DNA, 21 bp, Artificial Sequence
  Synthetic oligonucleotide
tgtatgcgaattcgctgcgcg

SEQ ID NO: 5236 - DNA, 23 bp, Artificial Sequence
  Synthetic oligonucleotide
ttcgcgcagcgaattcgcataca

SEQ ID NO: 5237 - DNA, 21 bp, Artificial Sequence
  Synthetic oligonucleotide
cctacggaattctcactcagc

SEQ ID NO: 5238 - DNA, 23 bp, Artificial Sequence
  Synthetic oligonucleotide
ttgctgagtgagaattccgtagg

SEQ ID NO: 5239 - DNA, 21 bp, Artificial Sequence
  Synthetic oligonucleotide
gaatccgaattcctggtcagc

SEQ ID NO: 5240 - DNA, 23 bp, Artificial Sequence
  Synthetic oligonucleotide
ttgctgaccaggaattcggattc

SEQ ID NO: 5241 - DNA, 32 bp, Artificial Sequence
  Synthetic modified oligonucleotide
cuacuacuacuactcgagaattctggatcctc

SEQ ID NO: 5242 - DNA, 33 bp, Artificial Sequence
  Synthetic modified oligonucleotide
cuacuacuacuatgtatgcgaattcgctgcgcg

SEQ ID NO: 5243 - DNA, 33 bp, Artificial Sequence
  Synthetic modified oligonucleotide
cuacuacuacuacctacggaattctcactcagc

SEQ ID NO: 5244 - DNA, 33 bp, Artificial Sequence
  Synthetic modified oligonucleotide
cuacuacuacuagaatccgaattcctggtcagc

SEQ ID NO: 5245 - DNA, 20 bp, Artificial Sequence
  Primer
tggccctgtcaggaagagta

SEQ ID NO: 5246 - DNA, 20 bp, Artificial Sequence
  Primer
ttgatgctttcccatgtctg

SEQ ID NO: 5247 - DNA, 20 bp, Artificial Sequence
  Primer
tcaaaggccttgcattttct

SEQ ID NO: 5248 - DNA, 20 bp, Artificial Sequence
  Primer
tccccactctgtcatccttc

SEQ ID NO: 5249 - DNA, 20 bp, Artificial Sequence
  Primer
cctctccgcagttctttcac

SEQ ID NO: 5250 - DNA, 20 bp, Artificial Sequence
  Primer
gtatcccaaagaccaagcca

SEQ ID NO: 5251 - DNA, 20 bp, Artificial Sequence
  Primer
atggaacctctccaccacac

SEQ ID NO: 5252 - DNA, 20 bp, Artificial Sequence
  Primer
ctggctatgcagggagatgt

SEQ ID NO: 5253 - DNA, 19 bp, Artificial Sequence
  Primer
ccagaacccagcactttca

SEQ ID NO: 5254 - DNA, 20 bp, Artificial Sequence
  Primer
aaccaacaattgcacgttga

SEQ ID NO: 5255 - DNA, 19 bp, Artificial Sequence
  Primer
cagcgcttgtctgcattct

SEQ ID NO: 5256 - DNA, 26 bp, Artificial Sequence
  Primer
tgataattctgtacaaaaatgggtaa

SEQ ID NO: 5257 - DNA, 21 bp, Artificial Sequence
  Primer
cctagaacctgagggcttgtc

SEQ ID NO: 5258 - DNA, 19 bp, Artificial Sequence
  Primer
ggtgccagtgtggaagatg

SEQ ID NO: 5259 - DNA, 20 bp, Artificial Sequence
  Primer
caccacctcagagctgttca

SEQ ID NO: 5260 - DNA, 20 bp, Artificial Sequence
  Primer
ccaggacatggctgactttg

SEQ ID NO: 5261 - DNA, 22 bp, Artificial Sequence
  Primer
gaaatattccaattttgcctgg

SEQ ID NO: 5262 - DNA, 20 bp, Artificial Sequence
  Primer
cctgttttgctttgagtcca

SEQ ID NO: 5263 - DNA, 20 bp, Artificial Sequence
  Primer
cctggtgatctttggctgat

SEQ ID NO: 5264 - DNA, 21 bp, Artificial Sequence
  Primer
ggggagatcttcatttaccca

SEQ ID NO: 5265 - DNA, 22 bp, Artificial Sequence
  Primer
ggggaaaagggagaattctaaa

SEQ ID NO: 5266 - DNA, 20 bp, Artificial Sequence
  Primer
gcagtcattggaggagcttg

SEQ ID NO: 5267 - DNA, 18 bp, Artificial Sequence
  Primer
gagcaggggtggagagcc

SEQ ID NO: 5268 - DNA, 19 bp, Artificial Sequence
  Primer
gcaaggacatcggctacaa

SEQ ID NO: 5269 - DNA, 20 bp, Artificial Sequence
  Primer
tgcaccgagcaggtctctac

SEQ ID NO: 5270 - DNA, 20 bp, Artificial Sequence
  Primer
aactacctgtgcatggaggc

SEQ ID NO: 5271 - DNA, 20 bp, Artificial Sequence
  Primer
ctgcagagatctgggtcctc

SEQ ID NO: 5272 - DNA, 20 bp, Artificial Sequence
  Primer
ggagaatgctacgaggtgct

SEQ ID NO: 5273 - DNA, 20 bp, Artificial Sequence
  Primer
gtccgcatttctgcttcttc

SEQ ID NO: 5274 - DNA, 20 bp, Artificial Sequence
  Primer
gaggctgaagacctgacctg

SEQ ID NO: 5275 - DNA, 20 bp, Artificial Sequence
  Primer
gagggccactgtgtctgtct

SEQ ID NO: 5276 - DNA, 20 bp, Artificial Sequence
  Primer
aactaagacagccaggcagc

SEQ ID NO: 5277 - DNA, 20 bp, Artificial Sequence
  Primer
tcccagtgtacaaagcacca

SEQ ID NO: 5278 - DNA, 19 bp, Artificial Sequence
  Primer
gtgagtttgacctgggcct

SEQ ID NO: 5279 - DNA, 20 bp, Artificial Sequence
  Primer
aggctgagaccaaaaccctt

SEQ ID NO: 5280 - DNA, 20 bp, Artificial Sequence
  Primer
tgtcgatgaggaagtcgatg

SEQ ID NO: 5281 - DNA, 20 bp, Artificial Sequence
  Primer
ggaatctctccgtgtcttgg

SEQ ID NO: 5282 - DNA, 24 bp, Artificial Sequence
  Primer
ctttgttaaaatccatcagttttg

SEQ ID NO: 5283 - DNA, 20 bp, Artificial Sequence
  Primer
ctgtggctctcagggagttg

SEQ ID NO: 5284 - DNA, 20 bp, Artificial Sequence
  Primer
aggtggcgtagcacctgtag

SEQ ID NO: 5285 - DNA, 20 bp, Artificial Sequence
  Primer
actgcccttcactctttgga

SEQ ID NO: 5286 - DNA, 20 bp, Artificial Sequence
  Primer
acagacaggatttcgccttg

SEQ ID NO: 5287 - DNA, 20 bp, Artificial Sequence
  Primer
ccgaggaaagtggagttgag

SEQ ID NO: 5288 - DNA, 20 bp, Artificial Sequence
  Primer
tactctccaccctcctctgc

SEQ ID NO: 5289 - DNA, 20 bp, Artificial Sequence
  Primer
acaaccctttattcagcccc

SEQ ID NO: 5290 - DNA, 20 bp, Artificial Sequence
  Primer
gtgttcagaggatgggcatt

SEQ ID NO: 5291 - DNA, 20 bp, Artificial Sequence
  Primer
ccctcccagtaactgcaaaa

SEQ ID NO: 5292 - DNA, 21 bp, Artificial Sequence
  Primer
ggaaaagatgatcacgtggaa

SEQ ID NO: 5293 - DNA, 20 bp, Artificial Sequence
  Primer
caggttgggcatacgagtca

SEQ ID NO: 5294 - DNA, 20 bp, Artificial Sequence
  Primer
ataatcggggagcacttgag

SEQ ID NO: 5295 - DNA, 18 bp, Artificial Sequence
  Primer
gtccttcagcgggtgctc

SEQ ID NO: 5296 - DNA, 19 bp, Artificial Sequence
  Primer
gaaggtgagcacggtgaag

SEQ ID NO: 5297 - DNA, 19 bp, Artificial Sequence
  Primer
cgtgctcaccttcctcatc

SEQ ID NO: 5298 - DNA, 18 bp, Artificial Sequence
  Primer
ctgtggtgggtggtcctc

SEQ ID NO: 5299 - DNA, 19 bp, Artificial Sequence
  Primer
tctgctacgtgggcagcat

SEQ ID NO: 5300 - DNA, 20 bp, Artificial Sequence
  Primer
ctctgtgctgtacaccgtgc

SEQ ID NO: 5301 - DNA, 20 bp, Artificial Sequence
  Primer
cctccaagactctgcagtcc

SEQ ID NO: 5302 - DNA, 20 bp, Artificial Sequence
  Primer
aaatatgagatccctgccca

SEQ ID NO: 5303 - DNA, 20 bp, Artificial Sequence
  Primer
tgaaattcaggatgctgtga

SEQ ID NO: 5304 - DNA, 20 bp, Artificial Sequence
  Primer
ttgagttggctttgctaccc

SEQ ID NO: 5305 - DNA, 20 bp, Artificial Sequence
  Primer
ctgcaagacagaaacctcca

SEQ ID NO: 5306 - DNA, 20 bp, Artificial Sequence
  Primer
taatggaaaccaagccaatg

SEQ ID NO: 5307 - DNA, 20 bp, Artificial Sequence
  Primer
tgccaggaaagagtggtttc

SEQ ID NO: 5308 - DNA, 19 bp, Artificial Sequence
  Primer
agggtataggatgcacgcc

SEQ ID NO: 5309 - DNA, 20 bp, Artificial Sequence
  Primer
acacacatttccaccaccaa

SEQ ID NO: 5310 - DNA, 20 bp, Artificial Sequence
  Primer
ccggactcaaagtgagcagt

SEQ ID NO: 5311 - DNA, 20 bp, Artificial Sequence
  Primer
catgaccaacgtgctttgac

SEQ ID NO: 5312 - DNA, 20 bp, Artificial Sequence
  Primer
gtcaggagagcgctattgga

SEQ ID NO: 5313 - DNA, 20 bp, Artificial Sequence
  Primer
cctccagcttcaataaccca

SEQ ID NO: 5314 - DNA, 21 bp, Artificial Sequence
  Primer
tgtgtcctccagagcctctaa

SEQ ID NO: 5315 - DNA, 20 bp, Artificial Sequence
  Primer
ctgtgttggctgggtgataa

SEQ ID NO: 5316 - DNA, 20 bp, Artificial Sequence
  Primer
gagagcacatcctggacctc

SEQ ID NO: 5317 - DNA, 18 bp, Artificial Sequence
  Primer
gccaccaggatggggaac

SEQ ID NO: 5318 - DNA, 18 bp, Artificial Sequence
  Primer
gtgggcaaggacgtggtg

SEQ ID NO: 5319 - DNA, 20 bp, Artificial Sequence
  Primer
cacgtcatcttcctcaacga

SEQ ID NO: 5320 - DNA, 20 bp, Artificial Sequence
  Primer
accgaatgatctcgtttcca

SEQ ID NO: 5321 - DNA, 20 bp, Artificial Sequence
  Primer
cacccccacaagatgttacc

SEQ ID NO: 5322 - DNA, 18 bp, Artificial Sequence
  Primer
ggctccccattgcaggac

SEQ ID NO: 5323 - DNA, 19 bp, Artificial Sequence
  Primer
actctgcagttgctgccgt

SEQ ID NO: 5324 - DNA, 18 bp, Artificial Sequence
  Primer
cacgccaggatggatgag

SEQ ID NO: 5325 - DNA, 19 bp, Artificial Sequence
  Primer
gtagctgaaggtggccctg

SEQ ID NO: 5326 - DNA, 18 bp, Artificial Sequence
  Primer
tgtaggatgcgggaggag

SEQ ID NO: 5327 - DNA, 20 bp, Artificial Sequence
  Primer
atgctggcgagacttacgac

SEQ ID NO: 5328 - DNA, 20 bp, Artificial Sequence
  Primer
cacgctcctcagttaggctc

SEQ ID NO: 5329 - DNA, 20 bp, Artificial Sequence
  Primer
agaccgcctttctccagact

SEQ ID NO: 5330 - DNA, 18 bp, Artificial Sequence
  Primer
gtgaggaccacccaccac

SEQ ID NO: 5331 - DNA, 18 bp, Artificial Sequence
  Primer
gtagcaggccaggggaat

SEQ ID NO: 5332 - DNA, 20 bp, Artificial Sequence
  Primer
ccatgttgaggcgttcgtaa

SEQ ID NO: 5333 - DNA, 20 bp, Artificial Sequence
  Primer
ggttttctccggctcttctt

SEQ ID NO: 5334 - DNA, 20 bp, Artificial Sequence
  Primer
cacaaccaagaaaagcacca

SEQ ID NO: 5335 - DNA, 20 bp, Artificial Sequence
  Primer
cttcgctggaaaaccaaaac

SEQ ID NO: 5336 - DNA, 21 bp, Artificial Sequence
  Primer
ttgcaaagcagttatctgtcc

SEQ ID NO: 5337 - DNA, 21 bp, Artificial Sequence
  Primer
tgtgaggtttgatggaggttt

SEQ ID NO: 5338 - DNA, 20 bp, Artificial Sequence
  Primer
tccacaaatcagtccaaacg

SEQ ID NO: 5339 - DNA, 22 bp, Artificial Sequence
  Primer
caaatatacacacgcagaaacc

SEQ ID NO: 5340 - DNA, 20 bp, Artificial Sequence
  Primer
gctagaagcacaaccccaga

SEQ ID NO: 5341 - DNA, 18 bp, Artificial Sequence
  Primer
ctccaccacaccagggat

SEQ ID NO: 5342 - DNA, 20 bp, Artificial Sequence
  Primer
catgaactgtgggaaaggct

SEQ ID NO: 5343 - DNA, 20 bp, Artificial Sequence
  Primer
atttcacctgtgcacaccct

SEQ ID NO: 5344 - DNA, 19 bp, Artificial Sequence
  Primer
atcttgcgctaccggatct

SEQ ID NO: 5345 - DNA, 20 bp, Artificial Sequence
  Primer
aacaggacaaactggccaac

SEQ ID NO: 5346 - DNA, 20 bp, Artificial Sequence
  Primer
aaatcccaccttctcctcgt

SEQ ID NO: 5347 - DNA, 20 bp, Artificial Sequence
  Primer
gggagccctgcctatctatc

SEQ ID NO: 5348 - DNA, 19 bp, Artificial Sequence
  Primer
ggcactgttgtcggtgatg

SEQ ID NO: 5349 - DNA, 20 bp, Artificial Sequence
  Primer
ttcatgcgtgtctccttgtc

SEQ ID NO: 5350 - DNA, 19 bp, Artificial Sequence
  Primer
tctgcgtgatgttgtccac

SEQ ID NO: 5351 - DNA, 18 bp, Artificial Sequence
  Primer
ctccctttgctccagcgg

SEQ ID NO: 5352 - DNA, 19 bp, Artificial Sequence
  Primer
ggaaggacacagggctcac

SEQ ID NO: 5353 - DNA, 20 bp, Artificial Sequence
  Primer
aaaactcaccctctgccctt

SEQ ID NO: 5354 - DNA, 20 bp, Artificial Sequence
  Primer
agtgatcagggctggaagag

SEQ ID NO: 5355 - DNA, 19 bp, Artificial Sequence
  Primer
tgattggggtgcaggtctc

SEQ ID NO: 5356 - DNA, 18 bp, Artificial Sequence
  Primer
ctgtggctgtggcaggat

SEQ ID NO: 5357 - DNA, 18 bp, Artificial Sequence
  Primer
gactgaggagccaccgag

SEQ ID NO: 5358 - DNA, 18 bp, Artificial Sequence
  Primer
ccaccaggaggatggtgt

SEQ ID NO: 5359 - DNA, 19 bp, Artificial Sequence
  Primer
agctactctggggacggag

SEQ ID NO: 5360 - DNA, 20 bp, Artificial Sequence
  Primer
tttgcttagcggaaaatgct

SEQ ID NO: 5361 - DNA, 20 bp, Artificial Sequence
  Primer
caccttgatgatctggcctt

SEQ ID NO: 5362 - DNA, 20 bp, Artificial Sequence
  Primer
gtcgataccctgttgccagt

SEQ ID NO: 5363 - DNA, 23 bp, Artificial Sequence
  Primer
ctgaaccaatcaattacagtgct

SEQ ID NO: 5364 - DNA, 20 bp, Artificial Sequence
  Primer
aggggaacaccgctaagttt

SEQ ID NO: 5365 - DNA, 23 bp, Artificial Sequence
  Primer
ttctcaaatagtaagggaaagca

SEQ ID NO: 5366 - DNA, 21 bp, Artificial Sequence
  Primer
tcctttagccaaagcaagatg

SEQ ID NO: 5367 - DNA, 20 bp, Artificial Sequence
  Primer
ccaagggcttctcaagcata

SEQ ID NO: 5368 - DNA, 22 bp, Artificial Sequence
  Primer
gcccctaactgatacagaggaa

SEQ ID NO: 5369 - DNA, 20 bp, Artificial Sequence
  Primer
ggagctcctaaccactgcac

SEQ ID NO: 5370 - DNA, 20 bp, Artificial Sequence
  Primer
agaggaagcaacggatacca

SEQ ID NO: 5371 - DNA, 19 bp, Artificial Sequence
  Primer
acctgccacgatagcacag

SEQ ID NO: 5372 - DNA, 20 bp, Artificial Sequence
  Primer
cactgtgttaaaacgcctgg

SEQ ID NO: 5373 - DNA, 20 bp, Artificial Sequence
  Primer
cagaagcaacccacatgacc

SEQ ID NO: 5374 - DNA, 18 bp, Artificial Sequence
  Primer
gcccttagggagagcagc

SEQ ID NO: 5375 - DNA, 20 bp, Artificial Sequence
  Primer
atgctctcctgatggctcct

SEQ ID NO: 5376 - DNA, 20 bp, Artificial Sequence
  Primer
actcgggaaaggaaggctct

SEQ ID NO: 5377 - DNA, 20 bp, Artificial Sequence
  Primer
agacagtgttgttcccggag

SEQ ID NO: 5378 - DNA, 20 bp, Artificial Sequence
  Primer
atatgtttgctggctttggg

SEQ ID NO: 5379 - DNA, 20 bp, Artificial Sequence
  Primer
ctgcttcaagatgccagtga

SEQ ID NO: 5380 - DNA, 20 bp, Artificial Sequence
  Primer
ccgtcccaggataccttttc

SEQ ID NO: 5381 - DNA, 20 bp, Artificial Sequence
  Primer
acacccatcaccttacatgg

SEQ ID NO: 5382 - DNA, 19 bp, Artificial Sequence
  Primer
tatctggacgtggtggtgc

SEQ ID NO: 5383 - DNA, 20 bp, Artificial Sequence
  Primer
cgggcgtgtatatctcttca

SEQ ID NO: 5384 - DNA, 21 bp, Artificial Sequence
  Primer
tgtacgaacagtccagacgag

SEQ ID NO: 5385 - DNA, 20 bp, Artificial Sequence
  Primer
cgacatgatcacaagcgaaa

SEQ ID NO: 5386 - DNA, 20 bp, Artificial Sequence
  Primer
cgaataaaggcgtcgagaag

SEQ ID NO: 5387 - DNA, 20 bp, Artificial Sequence
  Primer
cacctgtcacctgccttgta

SEQ ID NO: 5388 - DNA, 18 bp, Artificial Sequence
  Primer
cccagccccttctcactg

SEQ ID NO: 5389 - DNA, 20 bp, Artificial Sequence
  Primer
cagcaagtccctcctgatgt

SEQ ID NO: 5390 - DNA, 20 bp, Artificial Sequence
  Primer
gcagatcccaggaagaacaa

SEQ ID NO: 5391 - DNA, 20 bp, Artificial Sequence
  Primer
tgtggggtacagtggcatta

SEQ ID NO: 5392 - DNA, 20 bp, Artificial Sequence
  Primer
atccagagataccccagcct

SEQ ID NO: 5393 - DNA, 20 bp, Artificial Sequence
  Primer
gcctgtgggtattttgcact

SEQ ID NO: 5394 - DNA, 21 bp, Artificial Sequence
  Primer
ttgattggatttgagctctgc

SEQ ID NO: 5395 - DNA, 20 bp, Artificial Sequence
  Primer
ttggcagacagaagaggagg

SEQ ID NO: 5396 - DNA, 22 bp, Artificial Sequence
  Primer
gataaaatgcacagggaaggtc

SEQ ID NO: 5397 - DNA, 20 bp, Artificial Sequence
  Primer
gtggtgtaccacgagggaag

SEQ ID NO: 5398 - DNA, 20 bp, Artificial Sequence
  Primer
atgacgttcatgcccaattt

SEQ ID NO: 5399 - DNA, 20 bp, Artificial Sequence
  Primer
atatggcagaacgggacaga

SEQ ID NO: 5400 - DNA, 20 bp, Artificial Sequence
  Primer
acactggcccggttaaggta

SEQ ID NO: 5401 - DNA, 20 bp, Artificial Sequence
  Primer
aaggaggcagacaagcaaaa

SEQ ID NO: 5402 - DNA, 20 bp, Artificial Sequence
  Primer
cttcccagttgttcctccct

SEQ ID NO: 5403 - DNA, 20 bp, Artificial Sequence
  Primer
tcacaccgacctcacaaaga

SEQ ID NO: 5404 - DNA, 20 bp, Artificial Sequence
  Primer
ataggtgaggagaacgtggc

SEQ ID NO: 5405 - DNA, 20 bp, Artificial Sequence
  Primer
gttgggattacaggcacgag

SEQ ID NO: 5406 - DNA, 20 bp, Artificial Sequence
  Primer
actacaggtttgcaccacca

SEQ ID NO: 5407 - DNA, 20 bp, Artificial Sequence
  Primer
ccacatcgtgcctttgtgta

SEQ ID NO: 5408 - DNA, 19 bp, Artificial Sequence
  Primer
agggaatgcaggtgcaaag

SEQ ID NO: 5409 - DNA, 20 bp, Artificial Sequence
  Primer
cataccttgagtgcacaccg

SEQ ID NO: 5410 - DNA, 20 bp, Artificial Sequence
  Primer
tcactgctcacccacgttag

SEQ ID NO: 5411 - DNA, 20 bp, Artificial Sequence
  Primer
gaaggagtgagccggtaaca

SEQ ID NO: 5412 - DNA, 19 bp, Artificial Sequence
  Primer
aacaaacgcctgggttgag

SEQ ID NO: 5413 - DNA, 20 bp, Artificial Sequence
  Primer
cccaggctgtgtgtcctcta

SEQ ID NO: 5414 - DNA, 21 bp, Artificial Sequence
  Primer
aatgaacgtggtgactacagc

SEQ ID NO: 5415 - DNA, 20 bp, Artificial Sequence
  Primer
agcagagtgaacagtggctg

SEQ ID NO: 5416 - DNA, 19 bp, Artificial Sequence
  Primer
ttcgcttgtgatcatgtcg

SEQ ID NO: 5417 - DNA, 21 bp, Artificial Sequence
  Primer
gccatggttgttaaattaggc

SEQ ID NO: 5418 - DNA, 20 bp, Artificial Sequence
  Primer
tttggtctgcttcagtggtg

SEQ ID NO: 5419 - DNA, 20 bp, Artificial Sequence
  Primer
cagggtcctcttcagagtcg

SEQ ID NO: 5420 - DNA, 18 bp, Artificial Sequence
  Primer
gggacccaccttgctgag

SEQ ID NO: 5421 - DNA, 20 bp, Artificial Sequence
  Primer
ggaaaagggacctgggaagt

SEQ ID NO: 5422 - DNA, 20 bp, Artificial Sequence
  Primer
tttagcttccctcccctcag

SEQ ID NO: 5423 - DNA, 20 bp, Artificial Sequence
  Primer
agctgccaccctctcatcta

SEQ ID NO: 5424 - DNA, 19 bp, Artificial Sequence
  Primer
gcaaacccactcaccctct

SEQ ID NO: 5425 - DNA, 20 bp, Artificial Sequence
  Primer
caaaggtggtttctggcagt

SEQ ID NO: 5426 - DNA, 20 bp, Artificial Sequence
  Primer
acctaccccaacttgtgacg

SEQ ID NO: 5427 - DNA, 20 bp, Artificial Sequence
  Primer
ccgtggagagacaccttcac

SEQ ID NO: 5428 - DNA, 19 bp, Artificial Sequence
  Primer
tttcctgtaggtccatgag

SEQ ID NO: 5429 - DNA, 20 bp, Artificial Sequence
  Primer
ttatctgggcagggttgtgt

SEQ ID NO: 5430 - DNA, 20 bp, Artificial Sequence
  Primer
ctggcagaccgatttgaact

SEQ ID NO: 5431 - DNA, 20 bp, Artificial Sequence
  Primer
gtgagggctgacctattgct

SEQ ID NO: 5432 - DNA, 20 bp, Artificial Sequence
  Primer
ttcttcttgccccagattgt

SEQ ID NO: 5433 - DNA, 20 bp, Artificial Sequence
  Primer
aaggcacacaagaacctgga

SEQ ID NO: 5434 - DNA, 20 bp, Artificial Sequence
  Primer
cctagagggtcatcgttccc

SEQ ID NO: 5435 - DNA, 20 bp, Artificial Sequence
  Primer
acccagaccgactaggggac

SEQ ID NO: 5436 - DNA, 20 bp, Artificial Sequence
  Primer
ttccccatcaattcaaatcc

SEQ ID NO: 5437 - DNA, 20 bp, Artificial Sequence
  Primer
tttcttggctctccgtgagt

SEQ ID NO: 5438 - DNA, 20 bp, Artificial Sequence
  Primer
gccacgtggactttcttttc

SEQ ID NO: 5439 - DNA, 20 bp, Artificial Sequence
  Primer
taggagacccctgtggacat

SEQ ID NO: 5440 - DNA, 20 bp, Artificial Sequence
  Primer
ctgcactcgaggtgacagag

SEQ ID NO: 5441 - DNA, 20 bp, Artificial Sequence
  Primer
tctctgaggttttcgtcgct

SEQ ID NO: 5442 - DNA, 19 bp, Artificial Sequence
  Primer
caggtgctgaggaaagcct

SEQ ID NO: 5443 - DNA, 20 bp, Artificial Sequence
  Primer
tgtgccagctccactctaac

SEQ ID NO: 5444 - DNA, 19 bp, Artificial Sequence
  Primer
gcccctgcagaaacacttt

SEQ ID NO: 5445 - DNA, 20 bp, Artificial Sequence
  Primer
ccattccggtaaagattcca

SEQ ID NO: 5446 - DNA, 20 bp, Artificial Sequence
  Primer
ctacttcagtgcaccttgcg

SEQ ID NO: 5447 - DNA, 20 bp, Artificial Sequence
  Primer
ccatcagtgtgctgagtgct

SEQ ID NO: 5448 - DNA, 20 bp, Artificial Sequence
  Primer
ccagatattccagcctcagc

SEQ ID NO: 5449 - DNA, 20 bp, Artificial Sequence
  Primer
ctgggtaggagcctggctat

SEQ ID NO: 5450 - DNA, 20 bp, Artificial Sequence
  Primer
ggaagaggtgctagacgctg

SEQ ID NO: 5451 - DNA, 18 bp, Artificial Sequence
  Primer
agtgggcctcagggtgac

SEQ ID NO: 5452 - DNA, 18 bp, Artificial Sequence
  Primer
atgtggcaaagccaggac

SEQ ID NO: 5453 - DNA, 20 bp, Artificial Sequence
  Primer
tcaatccccaatctcttcct

SEQ ID NO: 5454 - DNA, 20 bp, Artificial Sequence
  Primer
caacgccatccttacacaga

SEQ ID NO: 5455 - DNA, 20 bp, Artificial Sequence
  Primer
actgtgatggacctgctcct

SEQ ID NO: 5456 - DNA, 20 bp, Artificial Sequence
  Primer
caaaccattatgagcctggg

SEQ ID NO: 5457 - DNA, 23 bp, Artificial Sequence
  Primer
tgtggacttaacacctctccttc

SEQ ID NO: 5458 - DNA, 21 bp, Artificial Sequence
  Primer
gctccttagccaaatatggga

SEQ ID NO: 5459 - DNA, 19 bp, Artificial Sequence
  Primer
attccaaggccaagtcctg

SEQ ID NO: 5460 - DNA, 21 bp, Artificial Sequence
  Primer
caggtgctccttagccaaata

SEQ ID NO: 5461 - DNA, 20 bp, Artificial Sequence
  Primer
gctccatcggactcactagc

SEQ ID NO: 5462 - DNA, 20 bp, Artificial Sequence
  Primer
cccattccagaggagtgaga

SEQ ID NO: 5463 - DNA, 19 bp, Artificial Sequence
  Primer
ggcaggcactccaattttc

SEQ ID NO: 5464 - DNA, 20 bp, Artificial Sequence
  Primer
cggcctactgagaaccaact

SEQ ID NO: 5465 - DNA, 22 bp, Artificial Sequence
  Primer
tgagatgaggcagatagaggtg

SEQ ID NO: 5466 - DNA, 19 bp, Artificial Sequence
  Primer
aggtggcatcactgcactc

SEQ ID NO: 5467 - DNA, 20 bp, Artificial Sequence
  Primer
tcgtactcgaacaggaaggc

SEQ ID NO: 5468 - DNA, 18 bp, Artificial Sequence
  Primer
gaccgaggccaggatgag

SEQ ID NO: 5469 - DNA, 20 bp, Artificial Sequence
  Primer
tcaggccacgtcaatcatta

SEQ ID NO: 5470 - DNA, 20 bp, Artificial Sequence
  Primer
gagcgaaaagaaagtccacg

SEQ ID NO: 5471 - DNA, 20 bp, Artificial Sequence
  Primer
gggtcatgtgaaggaattgg

SEQ ID NO: 5472 - DNA, 21 bp, Artificial Sequence
  Primer
tgaggcacagaaaatcacttg

SEQ ID NO: 5473 - DNA, 20 bp, Artificial Sequence
  Primer
acacctggccaccacttact

SEQ ID NO: 5474 - DNA, 20 bp, Artificial Sequence
  Primer
gggatgagcagcagagacac

SEQ ID NO: 5475 - DNA, 19 bp, Artificial Sequence
  Primer
tgcctgagtgctggtcttc

SEQ ID NO: 5476 - DNA, 20 bp, Artificial Sequence
  Primer
atgtcaaatttccctgcctg

SEQ ID NO: 5477 - DNA, 20 bp, Artificial Sequence
  Primer
ggtcttggagaagggaaggt

SEQ ID NO: 5478 - DNA, 20 bp, Artificial Sequence
  Primer
acacccaagagatgagaggc

SEQ ID NO: 5479 - DNA, 20 bp, Artificial Sequence
  Primer
atttctctggggtgatgtgg

SEQ ID NO: 5480 - DNA, 20 bp, Artificial Sequence
  Primer
acaggcctcttaaattgcca

SEQ ID NO: 5481 - DNA, 20 bp, Artificial Sequence
  Primer
atcagtgccatctctgtccc

SEQ ID NO: 5482 - DNA, 20 bp, Artificial Sequence
  Primer
aaatgctcctgcctcagaaa

SEQ ID NO: 5483 - DNA, 20 bp, Artificial Sequence
  Primer
gctaggtgggatggggtatt

SEQ ID NO: 5484 - DNA, 20 bp, Artificial Sequence
  Primer
tctctgctccatcctcaggt

SEQ ID NO: 5485 - DNA, 20 bp, Artificial Sequence
  Primer
ccccaagcataggacacaga

SEQ ID NO: 5486 - DNA, 18 bp, Artificial Sequence
  Primer
ctcttccctctccttgcc

SEQ ID NO: 5487 - DNA, 24 bp, Artificial Sequence
  Primer
tgtggagtgtgtagtacttggtcc

SEQ ID NO: 5488 - DNA, 19 bp, Artificial Sequence
  Primer
tgtgttggtgtgggaggtc

SEQ ID NO: 5489 - DNA, 20 bp, Artificial Sequence
  Primer
gtcgttctgaccttcaagcc

SEQ ID NO: 5490 - DNA, 20 bp, Artificial Sequence
  Primer
tgagtgtgggagaagatccc

SEQ ID NO: 5491 - DNA, 20 bp, Artificial Sequence
  Primer
atagatccccagacccaacc

SEQ ID NO: 5492 - DNA, 20 bp, Artificial Sequence
  Primer
tctggcctgggataactcat

SEQ ID NO: 5493 - DNA, 20 bp, Artificial Sequence
  Primer
atagatccccagacccaacc

SEQ ID NO: 5494 - DNA, 20 bp, Artificial Sequence
  Primer
tggatttccaggacttgagg

SEQ ID NO: 5495 - DNA, 20 bp, Artificial Sequence
  Primer
tgttggggctggagtttatc

SEQ ID NO: 5496 - DNA, 20 bp, Artificial Sequence
  Primer
gccgttcgtgatggactact

SEQ ID NO: 5497 - DNA, 20 bp, Artificial Sequence
  Primer
cagccatcatctcttgcctt

SEQ ID NO: 5498 - DNA, 20 bp, Artificial Sequence
  Primer
gcatcatcctgttctgctca

SEQ ID NO: 5499 - DNA, 20 bp, Artificial Sequence
  Primer
ggccatcgtctttgtcatct

SEQ ID NO: 5500 - DNA, 20 bp, Artificial Sequence
  Primer
acttctccagcccatccttt

SEQ ID NO: 5501 - DNA, 20 bp, Artificial Sequence
  Primer
catggagcccctcttatctg

SEQ ID NO: 5502 - DNA, 22 bp, Artificial Sequence
  Primer
ggttttcatccttgaagactgt

SEQ ID NO: 5503 - DNA, 20 bp, Artificial Sequence
  Primer
taggcggcattgcctatatt

SEQ ID NO: 5504 - DNA, 21 bp, Artificial Sequence
  Primer
tgagctggtttcttacctcca

SEQ ID NO: 5505 - DNA, 20 bp, Artificial Sequence
  Primer
aggcattggagtctttcagc

SEQ ID NO: 5506 - DNA, 20 bp, Artificial Sequence
  Primer
gagagcacagttggtccaca

SEQ ID NO: 5507 - DNA, 20 bp, Artificial Sequence
  Primer
cctgtattgcggggagtaaa

SEQ ID NO: 5508 - DNA, 21 bp, Artificial Sequence
  Primer
cgaagtctcgtagccaacatc

SEQ ID NO: 5509 - DNA, 20 bp, Artificial Sequence
  Primer
ccatgtgttaaagtgcccct

SEQ ID NO: 5510 - DNA, 20 bp, Artificial Sequence
  Primer
gcttgcatcactgtgtttcc

SEQ ID NO: 5511 - DNA, 19 bp, Artificial Sequence
  Primer
gggacgtccttgacagaca

SEQ ID NO: 5512 - DNA, 20 bp, Artificial Sequence
  Primer
aaaatacctgtagcagcgca

SEQ ID NO: 5513 - DNA, 20 bp, Artificial Sequence
  Primer
gctaccctcctgcttttcct

SEQ ID NO: 5514 - DNA, 20 bp, Artificial Sequence
  Primer
tggtgctattcctgaacggg

SEQ ID NO: 5515 - DNA, 20 bp, Artificial Sequence
  Primer
ttccgtgactctgggatctt

SEQ ID NO: 5516 - DNA, 20 bp, Artificial Sequence
  Primer
ggaaaaccttgcttgtggaa

SEQ ID NO: 5517 - DNA, 21 bp, Artificial Sequence
  Primer
tgaggggagagatacaggtga

SEQ ID NO: 5518 - DNA, 21 bp, Artificial Sequence
  Primer
acaagaatgtgcctaactggc

SEQ ID NO: 5519 - DNA, 18 bp, Artificial Sequence
  Primer
accatgccttgccaagaa

SEQ ID NO: 5520 - DNA, 23 bp, Artificial Sequence
  Primer
cagtactacgacatttctgccaa

SEQ ID NO: 5521 - DNA, 20 bp, Artificial Sequence
  Primer
gattgttcggtttggcttgt

SEQ ID NO: 5522 - DNA, 20 bp, Artificial Sequence
  Primer
gaccagaatcccaagagcac

SEQ ID NO: 5523 - DNA, 20 bp, Artificial Sequence
  Primer
ttttgcccactgagatgcta

SEQ ID NO: 5524 - DNA, 20 bp, Artificial Sequence
  Primer
actgctttgtctcctgggaa

SEQ ID NO: 5525 - DNA, 21 bp, Artificial Sequence
  Primer
tgtttggcttgatcactgaga

SEQ ID NO: 5526 - DNA, 20 bp, Artificial Sequence
  Primer
aggaaggtgtttatgcacgg

SEQ ID NO: 5527 - DNA, 23 bp, Artificial Sequence
  Primer
caggtgagtttagtttcctgtcc

SEQ ID NO: 5528 - DNA, 20 bp, Artificial Sequence
  Primer
tcatggcaaacatgaagagc

SEQ ID NO: 5529 - DNA, 20 bp, Artificial Sequence
  Primer
gccattctggatcagcaact

SEQ ID NO: 5530 - DNA, 20 bp, Artificial Sequence
  Primer
ccaccatgatgaaggtgatg

SEQ ID NO: 5531 - DNA, 20 bp, Artificial Sequence
  Primer
tgataaagaacgccaggtcc

SEQ ID NO: 5532 - DNA, 20 bp, Artificial Sequence
  Primer
gctcgtgctgcggttattat

SEQ ID NO: 5533 - DNA, 20 bp, Artificial Sequence
  Primer
gcaacagcccaactgtttct

SEQ ID NO: 5534 - DNA, 20 bp, Artificial Sequence
  Primer
gcaaccagtctcccactcat

SEQ ID NO: 5535 - DNA, 19 bp, Artificial Sequence
  Primer
ccacagaggaagaccacaa

SEQ ID NO: 5536 - DNA, 20 bp, Artificial Sequence
  Primer
acctttcaaacagcccaaga

SEQ ID NO: 5537 - DNA, 20 bp, Artificial Sequence
  Primer
caaagccaagaaaacaggga

SEQ ID NO: 5538 - DNA, 20 bp, Artificial Sequence
  Primer
aaatggccaaaacaagtgct

SEQ ID NO: 5539 - DNA, 20 bp, Artificial Sequence
  Primer
acaatgcttttgtgtcggtg

SEQ ID NO: 5540 - DNA, 20 bp, Artificial Sequence
  Primer
tctgaatccacaactgctgc

SEQ ID NO: 5541 - DNA, 20 bp, Artificial Sequence
  Primer
gtgcctggactcagacacct

SEQ ID NO: 5542 - DNA, 20 bp, Artificial Sequence
  Primer
cccctcactggctattttca

SEQ ID NO: 5543 - DNA, 20 bp, Artificial Sequence
  Primer
agaaagggaagcttggggta

SEQ ID NO: 5544 - DNA, 20 bp, Artificial Sequence
  Primer
tggagctgtttttgtgcatc

SEQ ID NO: 5545 - DNA, 19 bp, Artificial Sequence
  Primer
attggctcttgatcgctga

SEQ ID NO: 5546 - DNA, 19 bp, Artificial Sequence
  Primer
atcaatccaggcaacatgc

SEQ ID NO: 5547 - DNA, 18 bp, Artificial Sequence
  Primer
gccgtgcagttgagcagg

SEQ ID NO: 5548 - DNA, 20 bp, Artificial Sequence
  Primer
atgaacctcaacacccaagg

SEQ ID NO: 5549 - DNA, 22 bp, Artificial Sequence
  Primer
tgttggaacagacctgattttc

SEQ ID NO: 5550 - DNA, 20 bp, Artificial Sequence
  Primer
tgttgccacacaacacaatg

SEQ ID NO: 5551 - DNA, 19 bp, Artificial Sequence
  Primer
gactccgtcttggggaaaa

SEQ ID NO: 5552 - DNA, 20 bp, Artificial Sequence
  Primer
gctcatactgtgctgccaaa

SEQ ID NO: 5553 - DNA, 20 bp, Artificial Sequence
  Primer
ggaataaacaagccaaaccg

SEQ ID NO: 5554 - DNA, 20 bp, Artificial Sequence
  Primer
tcagcatcccacagatgaag

SEQ ID NO: 5555 - DNA, 20 bp, Artificial Sequence
  Primer
tgctgtgattgccctaacaa

SEQ ID NO: 5556 - DNA, 20 bp, Artificial Sequence
  Primer
aaatccagtggcttccttcc

SEQ ID NO: 5557 - DNA, 20 bp, Artificial Sequence
  Primer
cacaaaactgaaaccctgcc

SEQ ID NO: 5558 - DNA, 20 bp, Artificial Sequence
  Primer
tgactgccaagcaattttca

SEQ ID NO: 5559 - DNA, 20 bp, Artificial Sequence
  Primer
gctctttcaccgaaaactgc

SEQ ID NO: 5560 - DNA, 20 bp, Artificial Sequence
  Primer
cctcccatcttgcagttcat

SEQ ID NO: 5561 - DNA, 22 bp, Artificial Sequence
  Primer
tcaggttgtctgtctgttgtca

SEQ ID NO: 5562 - DNA, 20 bp, Artificial Sequence
  Primer
catccccgtgagtttgattt

SEQ ID NO: 5563 - DNA, 21 bp, Artificial Sequence
  Primer
tcctgctccttctgtgtaagg

SEQ ID NO: 5564 - DNA, 20 bp, Artificial Sequence
  Primer
tgtgtcgtaggcatgaattg

SEQ ID NO: 5565 - DNA, 20 bp, Artificial Sequence
  Primer
ggagcatgtgaacacctgaa

SEQ ID NO: 5566 - DNA, 20 bp, Artificial Sequence
  Primer
agttttcagcacatccgtgt

SEQ ID NO: 5567 - DNA, 20 bp, Artificial Sequence
  Primer
ttgacctacaagctgtgcca

SEQ ID NO: 5568 - DNA, 21 bp, Artificial Sequence
  Primer
tccttccactaaagggtgtca

SEQ ID NO: 5569 - DNA, 22 bp, Artificial Sequence
  Primer
tgtgtcttcttgctgtgtctct

SEQ ID NO: 5570 - DNA, 18 bp, Artificial Sequence
  Primer
ggccagggacatcaggtt

SEQ ID NO: 5571 - DNA, 18 bp, Artificial Sequence
  Primer
cccctcaccctgctctct

SEQ ID NO: 5572 - DNA, 20 bp, Artificial Sequence
  Primer
agtgagctgggctaggctct

SEQ ID NO: 5573 - DNA, 20 bp, Artificial Sequence
  Primer
ctgctcctcatcctcacagg

SEQ ID NO: 5574 - DNA, 18 bp, Artificial Sequence
  Primer
gtcgaaggggtagccgtc

SEQ ID NO: 5575 - DNA, 19 bp, Artificial Sequence
  Primer
ggggtttctgacccctctt

SEQ ID NO: 5576 - DNA, 20 bp, Artificial Sequence
  Primer
accttgtcctcgtaggggag

SEQ ID NO: 5577 - DNA, 20 bp, Artificial Sequence
  Primer
cagagcctgtctgctgagtg

SEQ ID NO: 5578 - DNA, 19 bp, Artificial Sequence
  Primer
cacacaaggatgcctgtcc

SEQ ID NO: 5579 - DNA, 18 bp, Artificial Sequence
  Primer
tgggtgcagaccgtctct

SEQ ID NO: 5580 - DNA, 20 bp, Artificial Sequence
  Primer
cttggctgccctgtagtgat

SEQ ID NO: 5581 - DNA, 20 bp, Artificial Sequence
  Primer
cctcgtgtggtcatcgtaac

SEQ ID NO: 5582 - DNA, 19 bp, Artificial Sequence
  Primer
cgagggtacccactcccat

SEQ ID NO: 5583 - DNA, 20 bp, Artificial Sequence
  Primer
agcagggagaggtcatgttg

SEQ ID NO: 5584 - DNA, 18 bp, Artificial Sequence
  Primer
ccgagatgctccctccag

SEQ ID NO: 5585 - DNA, 20 bp, Artificial Sequence
  Primer
tcgtcagtcaacacagtccc

SEQ ID NO: 5586 - DNA, 20 bp, Artificial Sequence
  Primer
cacagtccttgccctctgtg

SEQ ID NO: 5587 - DNA, 20 bp, Artificial Sequence
  Primer
gtgcatgagcagacctcgta

SEQ ID NO: 5588 - DNA, 19 bp, Artificial Sequence
  Primer
ctccacacaccagccagtc

SEQ ID NO: 5589 - DNA, 20 bp, Artificial Sequence
  Primer
ttcagttcgctatttgtgcc

SEQ ID NO: 5590 - DNA, 21 bp, Artificial Sequence
  Primer
gatttgagtttgccatgctgt

SEQ ID NO: 5591 - DNA, 25 bp, Artificial Sequence
  Primer
atgttggatattatagctcagatgc

SEQ ID NO: 5592 - DNA, 20 bp, Artificial Sequence
  Primer
ttgaagtcaggcttggaaca

SEQ ID NO: 5593 - DNA, 20 bp, Artificial Sequence
  Primer
atggccctcagatacgaatg

SEQ ID NO: 5594 - DNA, 23 bp, Artificial Sequence
  Primer
aaacggcatctaccaattaaatc

SEQ ID NO: 5595 - DNA, 20 bp, Artificial Sequence
  Primer
ctcactgccacccacagtag

SEQ ID NO: 5596 - DNA, 20 bp, Artificial Sequence
  Primer
tttctggaagaccccagttt

SEQ ID NO: 5597 - DNA, 21 bp, Artificial Sequence
  Primer
ccctcatcctttcatcttgtg

SEQ ID NO: 5598 - DNA, 20 bp, Artificial Sequence
  Primer
gaaaccaccaccaaggagaa

SEQ ID NO: 5599 - DNA, 23 bp, Artificial Sequence
  Primer
gccttttaaaccacagctatttc

SEQ ID NO: 5600 - DNA, 20 bp, Artificial Sequence
  Primer
ctctggccaacaagaaaagc

SEQ ID NO: 5601 - DNA, 20 bp, Artificial Sequence
  Primer
tcctaatccccttcccaagt

SEQ ID NO: 5602 - DNA, 19 bp, Artificial Sequence
  Primer
accattgttattccgggct

SEQ ID NO: 5603 - DNA, 18 bp, Artificial Sequence
  Primer
gtctgcagctgccctgtt

SEQ ID NO: 5604 - DNA, 20 bp, Artificial Sequence
  Primer
cataagacgggactgtgcct

SEQ ID NO: 5605 - DNA, 18 bp, Artificial Sequence
  Primer
ggagaccccgttcctcac

SEQ ID NO: 5606 - DNA, 19 bp, Artificial Sequence
  Primer
ccctgaacttccacgaggt

SEQ ID NO: 5607 - DNA, 21 bp, Artificial Sequence
  Primer
cctgttctccgtgactcactc

SEQ ID NO: 5608 - DNA, 19 bp, Artificial Sequence
  Primer
cagtggctgtccacgagtt

SEQ ID NO: 5609 - DNA, 20 bp, Artificial Sequence
  Primer
gcccttcttgcccttagttc

SEQ ID NO: 5610 - DNA, 20 bp, Artificial Sequence
  Primer
ggacagggatgaggacagac

SEQ ID NO: 5611 - DNA, 18 bp, Artificial Sequence
  Primer
ggtctgcacccagagtgg

SEQ ID NO: 5612 - DNA, 18 bp, Artificial Sequence
  Primer
ctccatgaggcggacaga

SEQ ID NO: 5613 - DNA, 18 bp, Artificial Sequence
  Primer
catcgacgctgccttctc

SEQ ID NO: 5614 - DNA, 20 bp, Artificial Sequence
  Primer
ggctgacacaggagaaggaa

SEQ ID NO: 5615 - DNA, 18 bp, Artificial Sequence
  Primer
accaaccccacccacact

SEQ ID NO: 5616 - DNA, 18 bp, Artificial Sequence
  Primer
cagaagggtgcccagtca

SEQ ID NO: 5617 - DNA, 20 bp, Artificial Sequence
  Primer
cacagagggcaaggactgtg

SEQ ID NO: 5618 - DNA, 18 bp, Artificial Sequence
  Primer
ccaggccctgacgctatg

SEQ ID NO: 5619 - DNA, 18 bp, Artificial Sequence
  Primer
gcccctccaggacaacat

SEQ ID NO: 5620 - DNA, 20 bp, Artificial Sequence
  Primer
tgcctcctacttcttccgtg

SEQ ID NO: 5621 - DNA, 18 bp, Artificial Sequence
  Primer
cagtcttgtgcaagcccc

SEQ ID NO: 5622 - DNA, 20 bp, Artificial Sequence
  Primer
ggacaggtaggcaggctatg

SEQ ID NO: 5623 - DNA, 19 bp, Artificial Sequence
  Primer
acagccagagggacacaca

SEQ ID NO: 5624 - DNA, 23 bp, Artificial Sequence
  Primer
caaatacccatactcccaacatc

SEQ ID NO: 5625 - DNA, 23 bp, Artificial Sequence
  Primer
ttcagagtctgcaagaagaaagt

SEQ ID NO: 5626 - DNA, 23 bp, Artificial Sequence
  Primer
ttgaagtgagaccttaagggaga

SEQ ID NO: 5627 - DNA, 20 bp, Artificial Sequence
  Primer
atggttgcaaatggctttgt

SEQ ID NO: 5628 - DNA, 20 bp, Artificial Sequence
  Primer
ccctttaacttccaaaccca

SEQ ID NO: 5629 - DNA, 21 bp, Artificial Sequence
  Primer
ccattacatgcacatcgtgtt

SEQ ID NO: 5630 - DNA, 20 bp, Artificial Sequence
  Primer
gcaaatgccattgttgattt

SEQ ID NO: 5631 - DNA, 21 bp, Artificial Sequence
  Primer
tcagcttgcttttctttgaca

SEQ ID NO: 5632 - DNA, 17 bp, Artificial Sequence
  Primer
gggctcccgctggaaag

SEQ ID NO: 5633 - DNA, 20 bp, Artificial Sequence
  Primer
tagcatccacctgtggtccc

SEQ ID NO: 5634 - DNA, 20 bp, Artificial Sequence
  Primer
gcttccatggttgcttaaaa

SEQ ID NO: 5635 - DNA, 20 bp, Artificial Sequence
  Primer
taagaatgggttcgagggtg

SEQ ID NO: 5636 - DNA, 21 bp, Artificial Sequence
  Primer
ggtgctacctcctctgatcct

SEQ ID NO: 5637 - DNA, 20 bp, Artificial Sequence
  Primer
tagcctgtggtgagggcagt

SEQ ID NO: 5638 - DNA, 19 bp, Artificial Sequence
  Primer
tgccactcagggtgactgt

SEQ ID NO: 5639 - DNA, 20 bp, Artificial Sequence
  Primer
cctaactacgtgcaaagggc

SEQ ID NO: 5640 - DNA, 20 bp, Artificial Sequence
  Primer
atttccaaatcccaacctcc

SEQ ID NO: 5641 - DNA, 20 bp, Artificial Sequence
  Primer
tcactgggcttatggctctc

SEQ ID NO: 5642 - DNA, 19 bp, Artificial Sequence
  Primer
gcctccaactttgcctctc

SEQ ID NO: 5643 - DNA, 19 bp, Artificial Sequence
  Primer
tctcctcgccctctctctg

SEQ ID NO: 5644 - DNA, 19 bp, Artificial Sequence
  Primer
catttgtcttcactggccg

SEQ ID NO: 5645 - DNA, 20 bp, Artificial Sequence
  Primer
ccaagccccaaatttaagtg

SEQ ID NO: 5646 - DNA, 20 bp, Artificial Sequence
  Primer
catttcttggcacacaatgg

SEQ ID NO: 5647 - DNA, 20 bp, Artificial Sequence
  Primer
tatttcacccaggaggttcg

SEQ ID NO: 5648 - DNA, 20 bp, Artificial Sequence
  Primer
tcctcctaggaacagagcca

SEQ ID NO: 5649 - DNA, 20 bp, Artificial Sequence
  Primer
gtctttcccatccctcaaca

SEQ ID NO: 5650 - DNA, 20 bp, Artificial Sequence
  Primer
tagcgccctatccctttctt

SEQ ID NO: 5651 - DNA, 20 bp, Artificial Sequence
  Primer
ctctgaccttgcactacccc

SEQ ID NO: 5652 - DNA, 20 bp, Artificial Sequence
  Primer
acagaagaggacatggagcc

SEQ ID NO: 5653 - DNA, 22 bp, Artificial Sequence
  Primer
tcttggagaatgcaagagtctg

SEQ ID NO: 5654 - DNA, 20 bp, Artificial Sequence
  Primer
tcttcgaagccaaactcacc

SEQ ID NO: 5655 - DNA, 20 bp, Artificial Sequence
  Primer
cgggttacagcgtctgagat

SEQ ID NO: 5656 - DNA, 20 bp, Artificial Sequence
  Primer
gtggctggcaagcttttatt

SEQ ID NO: 5657 - DNA, 17 bp, Artificial Sequence
  Primer
ggcctgaaccgctaccc

SEQ ID NO: 5658 - DNA, 20 bp, Artificial Sequence
  Primer
cagaagccagaagggcaaag

SEQ ID NO: 5659 - DNA, 23 bp, Artificial Sequence
  Primer
tgcctttcaatcagtagaagaac

SEQ ID NO: 5660 - DNA, 21 bp, Artificial Sequence
  Primer
tggttgagagagcaagaggaa

SEQ ID NO: 5661 - DNA, 19 bp, Artificial Sequence
  Primer
cacctgcagcctcatggta

SEQ ID NO: 5662 - DNA, 21 bp, Artificial Sequence
  Primer
tcctgtgacctcaaagcatcc

SEQ ID NO: 5663 - DNA, 18 bp, Artificial Sequence
  Primer
tgcaagcctgctcctgat

SEQ ID NO: 5664 - DNA, 20 bp, Artificial Sequence
  Primer
gctcaggatttgagtcccag

SEQ ID NO: 5665 - DNA, 19 bp, Artificial Sequence
  Primer
ctgggaccctcggtttatg

SEQ ID NO: 5666 - DNA, 20 bp, Artificial Sequence
  Primer
gtccatgagcaaaggtggag

SEQ ID NO: 5667 - DNA, 20 bp, Artificial Sequence
  Primer
taaaacgcaaatcccacctc

SEQ ID NO: 5668 - DNA, 20 bp, Artificial Sequence
  Primer
taaaacgcaaatcccacctc

SEQ ID NO: 5669 - DNA, 18 bp, Artificial Sequence
  Primer
tggtgtctgccgctgatt

SEQ ID NO: 5670 - DNA, 20 bp, Artificial Sequence
  Primer
cctctcgcctaaaactgtgc

SEQ ID NO: 5671 - DNA, 20 bp, Artificial Sequence
  Primer
tggttgagccaccatactca

SEQ ID NO: 5672 - DNA, 20 bp, Artificial Sequence
  Primer
tgttgccaagaatgtggaaa

SEQ ID NO: 5673 - DNA, 20 bp, Artificial Sequence
  Primer
atgcactcagcgaccttctc

SEQ ID NO: 5674 - DNA, 20 bp, Artificial Sequence
  Primer
gggaggcataatgaaccaga

SEQ ID NO: 5675 - DNA, 20 bp, Artificial Sequence
  Primer
tccatcccaagcttcactct

SEQ ID NO: 5676 - DNA, 20 bp, Artificial Sequence
  Primer
ccaccgtgtcttcaaattca

SEQ ID NO: 5677 - DNA, 20 bp, Artificial Sequence
  Primer
ccagatactgggcaaaggag

SEQ ID NO: 5678 - DNA, 20 bp, Artificial Sequence
  Primer
agccagcagaatccacagtc

SEQ ID NO: 5679 - DNA, 20 bp, Artificial Sequence
  Primer
tcctgttactctcctgcggt

SEQ ID NO: 5680 - DNA, 19 bp, Artificial Sequence
  Primer
acagcaaggaggaagtccg

SEQ ID NO: 5681 - DNA, 20 bp, Artificial Sequence
  Primer
ttctcccagagcaagtgacc

SEQ ID NO: 5682 - DNA, 20 bp, Artificial Sequence
  Primer
agtgccctgaattccagtct

SEQ ID NO: 5683 - DNA, 20 bp, Artificial Sequence
  Primer
agtgccctgaattccagtct

SEQ ID NO: 5684 - DNA, 19 bp, Artificial Sequence
  Primer
cccagaacccagcactttc

SEQ ID NO: 5685 - DNA, 20 bp, Artificial Sequence
  Primer
gtctccccttaatgtgtggg

SEQ ID NO: 5686 - DNA, 20 bp, Artificial Sequence
  Primer
ccagcacttgaacgcatcta

SEQ ID NO: 5687 - DNA, 18 bp, Artificial Sequence
  Primer
agcatggggttcccattt

SEQ ID NO: 5688 - DNA, 19 bp, Artificial Sequence
  Primer
cgattcctggacaaccaga

SEQ ID NO: 5689 - DNA, 20 bp, Artificial Sequence
  Primer
gaacacatgcatggtcctga

SEQ ID NO: 5690 - DNA, 20 bp, Artificial Sequence
  Primer
ctcaactccactttcctcgg

SEQ ID NO: 5691 - DNA, 21 bp, Artificial Sequence
  Primer
tgcatctttgagtgactgctg

SEQ ID NO: 5692 - DNA, 20 bp, Artificial Sequence
  Primer
tcttgtgacatttgcaaggc

SEQ ID NO: 5693 - DNA, 19 bp, Artificial Sequence
  Primer
ctcgcttcccggtattgtt

SEQ ID NO: 5694 - DNA, 20 bp, Artificial Sequence
  Primer
ttcttcctgtgctcgctgta

SEQ ID NO: 5695 - DNA, 19 bp, Artificial Sequence
  Primer
cgtggacgtgtactggagc

SEQ ID NO: 5696 - DNA, 20 bp, Artificial Sequence
  Primer
agccaacagcagctacttcc

SEQ ID NO: 5697 - DNA, 20 bp, Artificial Sequence
  Primer
tctttatgctgctggtggtg

SEQ ID NO: 5698 - DNA, 19 bp, Artificial Sequence
  Primer
agggaagctcctccagtga

SEQ ID NO: 5699 - DNA, 20 bp, Artificial Sequence
  Primer
tgaactcaaacgatgtgcaa

SEQ ID NO: 5700 - DNA, 19 bp, Artificial Sequence
  Primer
ctcgcttcccggtattgtt

SEQ ID NO: 5701 - DNA, 19 bp, Artificial Sequence
  Primer
agggaagctcctccagtga

SEQ ID NO: 5702 - DNA, 19 bp, Artificial Sequence
  Primer
caaactttgctgctctccg

SEQ ID NO: 5703 - DNA, 20 bp, Artificial Sequence
  Primer
gcaccaggacatgaggctat

SEQ ID NO: 5704 - DNA, 20 bp, Artificial Sequence
  Primer
ggtaccctggaagatctggg

SEQ ID NO: 5705 - DNA, 20 bp, Artificial Sequence
  Primer
ccaactcacgcaaagaatga

SEQ ID NO: 5706 - DNA, 19 bp, Artificial Sequence
  Primer
tggaaaagggttctccagc

SEQ ID NO: 5707 - DNA, 21 bp, Artificial Sequence
  Primer
ccacaggaaaggaatacacca

SEQ ID NO: 5708 - DNA, 20 bp, Artificial Sequence
  Primer
cattcatcttgttgccttgg

SEQ ID NO: 5709 - DNA, 20 bp, Artificial Sequence
  Primer
cattcatcttgttgccttgg

SEQ ID NO: 5710 - DNA, 20 bp, Artificial Sequence
  Primer
tagaattgctttccaggccc

SEQ ID NO: 5711 - DNA, 19 bp, Artificial Sequence
  Primer
gggcctaattttcgtgcat

SEQ ID NO: 5712 - DNA, 20 bp, Artificial Sequence
  Primer
cttccctctatcttgcccct

SEQ ID NO: 5713 - DNA, 20 bp, Artificial Sequence
  Primer
attggaagggggcataaaag

SEQ ID NO: 5714 - DNA, 19 bp, Artificial Sequence
  Primer
ggacagtttgctgtgcctc

SEQ ID NO: 5715 - DNA, 20 bp, Artificial Sequence
  Primer
acagacaggatttcgccttg

SEQ ID NO: 5716 - DNA, 20 bp, Artificial Sequence
  Primer
caagaagcgccaagtcctac

SEQ ID NO: 5717 - DNA, 20 bp, Artificial Sequence
  Primer
actctggtctgcagttggtg

SEQ ID NO: 5718 - DNA, 20 bp, Artificial Sequence
  Primer
tcagaatgtgcacctgaagc

SEQ ID NO: 5719 - DNA, 20 bp, Artificial Sequence
  Primer
gcctccatgcacaggtagtt

SEQ ID NO: 5720 - DNA, 20 bp, Artificial Sequence
  Primer
ctctccagtccctcctggat

SEQ ID NO: 5721 - DNA, 20 bp, Artificial Sequence
  Primer
ctccagcttgtccgtgttct

SEQ ID NO: 5722 - DNA, 20 bp, Artificial Sequence
  Primer
gactgggcagggatctcata

SEQ ID NO: 5723 - DNA, 20 bp, Artificial Sequence
  Primer
gggtcctgtctttcctctgc

SEQ ID NO: 5724 - DNA, 20 bp, Artificial Sequence
  Primer
tctgccaacctagtgcttcc

SEQ ID NO: 5725 - DNA, 20 bp, Artificial Sequence
  Primer
ttccaacttcacacattgcc

SEQ ID NO: 5726 - DNA, 20 bp, Artificial Sequence
  Primer
gcctccatgcacaggtagtt

SEQ ID NO: 5727 - DNA, 20 bp, Artificial Sequence
  Primer
tctgccaacctagtgcttcc

SEQ ID NO: 5728 - DNA, 20 bp, Artificial Sequence
  Primer
agttggggtcgttcttgttg

SEQ ID NO: 5729 - DNA, 20 bp, Artificial Sequence
  Primer
caagaagaggccgaagtttg

SEQ ID NO: 5730 - DNA, 18 bp, Artificial Sequence
  Primer
gaggacacgtccaacgcc

SEQ ID NO: 5731 - DNA, 20 bp, Artificial Sequence
  Primer
caagaagaggccgaagtttg

SEQ ID NO: 5732 - DNA, 18 bp, Artificial Sequence
  Primer
gaggacacgtccaacgcc

SEQ ID NO: 5733 - DNA, 20 bp, Artificial Sequence
  Primer
actgctctcccgtgaaagtg

SEQ ID NO: 5734 - DNA, 20 bp, Artificial Sequence
  Primer
ttaagccaaggaaaggagca

SEQ ID NO: 5735 - DNA, 20 bp, Artificial Sequence
  Primer
atctgtgtgtgtgagctggc

SEQ ID NO: 5736 - DNA, 20 bp, Artificial Sequence
  Primer
aaatggttgacgtcactggc

SEQ ID NO: 5737 - DNA, 20 bp, Artificial Sequence
  Primer
tgttggagctgagagacctg

SEQ ID NO: 5738 - DNA, 19 bp, Artificial Sequence
  Primer
ctctgggcagaggactggt

SEQ ID NO: 5739 - DNA, 20 bp, Artificial Sequence
  Primer
accctgcctgatgagaagaa

SEQ ID NO: 5740 - DNA, 20 bp, Artificial Sequence
  Primer
aggcagattcctcagctcct

SEQ ID NO: 5741 - DNA, 20 bp, Artificial Sequence
  Primer
gcatttcccagaagatggtg

SEQ ID NO: 5742 - DNA, 19 bp, Artificial Sequence
  Primer
ctctgggcagaggactggt

SEQ ID NO: 5743 - DNA, 20 bp, Artificial Sequence
  Primer
gaactgccctgtccatctgt

SEQ ID NO: 5744 - DNA, 20 bp, Artificial Sequence
  Primer
acaactccaattggcgagaa

SEQ ID NO: 5745 - DNA, 20 bp, Artificial Sequence
  Primer
gaactgccctgtccatctgt

SEQ ID NO: 5746 - DNA, 20 bp, Artificial Sequence
  Primer
gaactgccctgtccatctgt

SEQ ID NO: 5747 - DNA, 20 bp, Artificial Sequence
  Primer
gacagtctgctccacatcca

SEQ ID NO: 5748 - DNA, 20 bp, Artificial Sequence
  Primer
atatgtttgctggctttggg

SEQ ID NO: 5749 - DNA, 20 bp, Artificial Sequence
  Primer
tgcttcctgtttgtcactgc

SEQ ID NO: 5750 - DNA, 20 bp, Artificial Sequence
  Primer
atggacctgggtgaggactt

SEQ ID NO: 5751 - DNA, 20 bp, Artificial Sequence
  Primer
cgaataaaggcgtcgagaag

SEQ ID NO: 5752 - DNA, 20 bp, Artificial Sequence
  Primer
aattgactttcccgccttct

SEQ ID NO: 5753 - DNA, 20 bp, Artificial Sequence
  Primer
aagcatcttggcgaagtcat

SEQ ID NO: 5754 - DNA, 20 bp, Artificial Sequence
  Primer
tgggcatcctgatgtacttg

SEQ ID NO: 5755 - DNA, 21 bp, Artificial Sequence
  Primer
tgtgaaaagtgttgctctgaa

SEQ ID NO: 5756 - DNA, 21 bp, Artificial Sequence
  Primer
tgtgaaaagtgttgctctgaa

SEQ ID NO: 5757 - DNA, 20 bp, Artificial Sequence
  Primer
tctttagcttggcatcaccc

SEQ ID NO: 5758 - DNA, 20 bp, Artificial Sequence
  Primer
ctgcactcgaggtgacagag

SEQ ID NO: 5759 - DNA, 20 bp, Artificial Sequence
  Primer
gctaggcatggtgagtggtt

SEQ ID NO: 5760 - DNA, 20 bp, Artificial Sequence
  Primer
ccatcagtgtgctgagtgct

SEQ ID NO: 5761 - DNA, 20 bp, Artificial Sequence
  Primer
tacagcgagcacaggaagaa

SEQ ID NO: 5762 - DNA, 18 bp, Artificial Sequence
  Primer
ctcgtccgagccgttgtt

SEQ ID NO: 5763 - DNA, 20 bp, Artificial Sequence
  Primer
tacagcgagcacaggaagaa

SEQ ID NO: 5764 - DNA, 18 bp, Artificial Sequence
  Primer
ctcgtccgagccgttgtt

SEQ ID NO: 5765 - DNA, 20 bp, Artificial Sequence
  Primer
ccatcagcatctgtgtgacc

SEQ ID NO: 5766 - DNA, 19 bp, Artificial Sequence
  Primer
cctcgatgggatttgcttt

SEQ ID NO: 5767 - DNA, 20 bp, Artificial Sequence
  Primer
gggtgctgaaagacaagagc

SEQ ID NO: 5768 - DNA, 18 bp, Artificial Sequence
  Primer
ctgtggctgtggcaggat

SEQ ID NO: 5769 - DNA, 24 bp, Artificial Sequence
  Primer
cctctaaactcctttacccagacc

SEQ ID NO: 5770 - DNA, 20 bp, Artificial Sequence
  Primer
tgacagagtccaccagcaaa

SEQ ID NO: 5771 - DNA, 20 bp, Artificial Sequence
  Primer
tgtttgcaagcaagacggta

SEQ ID NO: 5772 - DNA, 20 bp, Artificial Sequence
  Primer
cagagggcaaataacctcca

SEQ ID NO: 5773 - DNA, 20 bp, Artificial Sequence
  Primer
taatccagagcagagcaggg

SEQ ID NO: 5774 - DNA, 20 bp, Artificial Sequence
  Primer
tgacagagtccaccagcaaa

SEQ ID NO: 5775 - DNA, 20 bp, Artificial Sequence
  Primer
aaatctcaggctgggaggac

SEQ ID NO: 5776 - DNA, 20 bp, Artificial Sequence
  Primer
ccaagcagagataaccagca

SEQ ID NO: 5777 - DNA, 20 bp, Artificial Sequence
  Primer
aaatctcaggctgggaggac

SEQ ID NO: 5778 - DNA, 20 bp, Artificial Sequence
  Primer
aaatctcaggctgggaggac

SEQ ID NO: 5779 - DNA, 20 bp, Artificial Sequence
  Primer
tggagatgaagtcttgctct

SEQ ID NO: 5780 - DNA, 20 bp, Artificial Sequence
  Primer
cccaggctgtgtgtcctcta

SEQ ID NO: 5781 - DNA, 20 bp, Artificial Sequence
  Primer
tgaggacacgatgaacctga

SEQ ID NO: 5782 - DNA, 20 bp, Artificial Sequence
  Primer
gcagtgacaaacaggaagca

SEQ ID NO: 5783 - DNA, 19 bp, Artificial Sequence
  Primer
ccttcctggagaggacgtg

SEQ ID NO: 5784 - DNA, 20 bp, Artificial Sequence
  Primer
gcccagccatccttctactt

SEQ ID NO: 5785 - DNA, 20 bp, Artificial Sequence
  Primer
aaaggagacactgcccagaa

SEQ ID NO: 5786 - DNA, 19 bp, Artificial Sequence
  Primer
gtggtgcatgcctatggtc

SEQ ID NO: 5787 - DNA, 18 bp, Artificial Sequence
  Primer
agtttgggtgacagagcg

SEQ ID NO: 5788 - DNA, 18 bp, Artificial Sequence
  Primer
agtttgggtgacagagcg

SEQ ID NO: 5789 - DNA, 20 bp, Artificial Sequence
  Primer
acgcagagttgaaggtgctt

SEQ ID NO: 5790 - DNA, 20 bp, Artificial Sequence
  Primer
agccaggagatacgttgtgc

SEQ ID NO: 5791 - DNA, 20 bp, Artificial Sequence
  Primer
cgcaaggtgcactgaagtag

SEQ ID NO: 5792 - DNA, 20 bp, Artificial Sequence
  Primer
acccaaaatgtggaaaggtg

SEQ ID NO: 5793 - DNA, 20 bp, Artificial Sequence
  Primer
gcacaggcctctcatctctt

SEQ ID NO: 5794 - DNA, 20 bp, Artificial Sequence
  Primer
caagattcctctcacctcgg

SEQ ID NO: 5795 - DNA, 21 bp, Artificial Sequence
  Primer
tcactgttttccattgggtta

SEQ ID NO: 5796 - DNA, 21 bp, Artificial Sequence
  Primer
tcactgttttccattgggtta

SEQ ID NO: 5797 - DNA, 21 bp, Artificial Sequence
  Primer
ggctgcagaaaacttcactct

SEQ ID NO: 5798 - DNA, 20 bp, Artificial Sequence
  Primer
gctgggatgacaggtgtgag

SEQ ID NO: 5799 - DNA, 19 bp, Artificial Sequence
  Primer
aggagcctttcgtcctcaa

SEQ ID NO: 5800 - DNA, 21 bp, Artificial Sequence
  Primer
tcactgttttccattgggtta

SEQ ID NO: 5801 - DNA, 21 bp, Artificial Sequence
  Primer
tcactgttttccattgggtta

SEQ ID NO: 5802 - DNA, 21 bp, Artificial Sequence
  Primer
tgtgaaaagtgttgctctgaa

SEQ ID NO: 5803 - DNA, 21 bp, Artificial Sequence
  Primer
tgtgaaaagtgttgctctgaa

SEQ ID NO: 5804 - DNA, 20 bp, Artificial Sequence
  Primer
tctttagcttggcatcaccc

SEQ ID NO: 5805 - DNA, 20 bp, Artificial Sequence
  Primer
gctaggcatggtgagtggtt

SEQ ID NO: 5806 - DNA, 20 bp, Artificial Sequence
  Primer
ccatcagtgtgctgagtgct

SEQ ID NO: 5807 - DNA, 20 bp, Artificial Sequence
  Primer
gcacaggcctctcatctctt

SEQ ID NO: 5808 - DNA, 21 bp, Artificial Sequence
  Primer
tcactgttttccattgggtta

SEQ ID NO: 5809 - DNA, 21 bp, Artificial Sequence
  Primer
tcactgttttccattgggtta

SEQ ID NO: 5810 - DNA, 21 bp, Artificial Sequence
  Primer
ggctgcagaaaacttcactct

SEQ ID NO: 5811 - DNA, 19 bp, Artificial Sequence
  Primer
aggagcctttcgtcctcaa

SEQ ID NO: 5812 - DNA, 21 bp, Artificial Sequence
  Primer
tcactgttttccattgggtta

SEQ ID NO: 5813 - DNA, 21 bp, Artificial Sequence
  Primer
tcactgttttccattgggtta

SEQ ID NO: 5814 - DNA, 20 bp, Artificial Sequence
  Primer
gtcacacagccagtaggcag

SEQ ID NO: 5815 - DNA, 20 bp, Artificial Sequence
  Primer
aagagaaaatccggaggacc

SEQ ID NO: 5816 - DNA, 20 bp, Artificial Sequence
  Primer
ccaacttcagtttcccaacg

SEQ ID NO: 5817 - DNA, 20 bp, Artificial Sequence
  Primer
cacatatctgccctgctcct

SEQ ID NO: 5818 - DNA, 20 bp, Artificial Sequence
  Primer
cagccatcatctcttgcctt

SEQ ID NO: 5819 - DNA, 20 bp, Artificial Sequence
  Primer
tggacctggcgttctttatc

SEQ ID NO: 5820 - DNA, 23 bp, Artificial Sequence
  Primer
cgtagtttcctggtaaccattca

SEQ ID NO: 5821 - DNA, 20 bp, Artificial Sequence
  Primer
ggccatcgtctttgtcatct

SEQ ID NO: 5822 - DNA, 20 bp, Artificial Sequence
  Primer
ctgctgtgtgttccgagatg

SEQ ID NO: 5823 - DNA, 20 bp, Artificial Sequence
  Primer
ggccatcgtctttgtcatct

SEQ ID NO: 5824 - DNA, 20 bp, Artificial Sequence
  Primer
ttgattgtgttgcgcttctt

SEQ ID NO: 5825 - DNA, 20 bp, Artificial Sequence
  Primer
agagttgacccagccaagaa

SEQ ID NO: 5826 - DNA, 18 bp, Artificial Sequence
  Primer
aacagcagcaagcagcct

SEQ ID NO: 5827 - DNA, 20 bp, Artificial Sequence
  Primer
gtagggcaagagctgggatg

SEQ ID NO: 5828 - DNA, 20 bp, Artificial Sequence
  Primer
gtagggcaagagctgggatg

SEQ ID NO: 5829 - DNA, 20 bp, Artificial Sequence
  Primer
tgagtgctggtcttcagtgg

SEQ ID NO: 5830 - DNA, 20 bp, Artificial Sequence
  Primer
tcccaaagtgctcggattac

SEQ ID NO: 5831 - DNA, 20 bp, Artificial Sequence
  Primer
atgttgcccaaattggtttc

SEQ ID NO: 5832 - DNA, 20 bp, Artificial Sequence
  Primer
gtagggcaagagctgggatg

SEQ ID NO: 5833 - DNA, 20 bp, Artificial Sequence
  Primer
gtagggcaagagctgggatg

SEQ ID NO: 5834 - DNA, 18 bp, Artificial Sequence
  Primer
agtttgggtgacagagcg

SEQ ID NO: 5835 - DNA, 18 bp, Artificial Sequence
  Primer
agtttgggtgacagagcg

SEQ ID NO: 5836 - DNA, 20 bp, Artificial Sequence
  Primer
acgcagagttgaaggtgctt

SEQ ID NO: 5837 - DNA, 20 bp, Artificial Sequence
  Primer
cgcaaggtgcactgaagtag

SEQ ID NO: 5838 - DNA, 20 bp, Artificial Sequence
  Primer
acccaaaatgtggaaaggtg

SEQ ID NO: 5839 - DNA, 20 bp, Artificial Sequence
  Primer
agagttgacccagccaagaa

SEQ ID NO: 5840 - DNA, 20 bp, Artificial Sequence
  Primer
gtagggcaagagctgggatg

SEQ ID NO: 5841 - DNA, 20 bp, Artificial Sequence
  Primer
gtagggcaagagctgggatg

SEQ ID NO: 5842 - DNA, 20 bp, Artificial Sequence
  Primer
tgagtgctggtcttcagtgg

SEQ ID NO: 5843 - DNA, 20 bp, Artificial Sequence
  Primer
atgttgcccaaattggtttc

SEQ ID NO: 5844 - DNA, 20 bp, Artificial Sequence
  Primer
gtagggcaagagctgggatg

SEQ ID NO: 5845 - DNA, 20 bp, Artificial Sequence
  Primer
gtagggcaagagctgggatg

SEQ ID NO: 5846 - DNA, 20 bp, Artificial Sequence
  Primer
cagagagcaagaaggccaag

SEQ ID NO: 5847 - DNA, 19 bp, Artificial Sequence
  Primer
acggggtctccctgtgata

SEQ ID NO: 5848 - DNA, 20 bp, Artificial Sequence
  Primer
cagggacgtggactctgata

SEQ ID NO: 5849 - DNA, 20 bp, Artificial Sequence
  Primer
caccatcaggattcttcacg

SEQ ID NO: 5850 - DNA, 20 bp, Artificial Sequence
  Primer
attactcgatgcaacagccc

SEQ ID NO: 5851 - DNA, 20 bp, Artificial Sequence
  Primer
caggagcaacacaattccct

SEQ ID NO: 5852 - DNA, 20 bp, Artificial Sequence
  Primer
ttggagatcttgttcagggc

SEQ ID NO: 5853 - DNA, 20 bp, Artificial Sequence
  Primer
gcgtcagagatgaagcaagt

SEQ ID NO: 5854 - DNA, 20 bp, Artificial Sequence
  Primer
gtgtgcaggagccagaagat

SEQ ID NO: 5855 - DNA, 20 bp, Artificial Sequence
  Primer
gcgtcagagatgaagcaagt

SEQ ID NO: 5856 - DNA, 20 bp, Artificial Sequence
  Primer
gcatgagctctggaatcagg

SEQ ID NO: 5857 - DNA, 21 bp, Artificial Sequence
  Primer
cacctgattattttcccctca

SEQ ID NO: 5858 - DNA, 20 bp, Artificial Sequence
  Primer
ctgagtgagcggaggtgttt

SEQ ID NO: 5859 - DNA, 18 bp, Artificial Sequence
  Primer
cagacagcccacctccag

SEQ ID NO: 5860 - DNA, 20 bp, Artificial Sequence
  Primer
gctggcactggtgtctatca

SEQ ID NO: 5861 - DNA, 21 bp, Artificial Sequence
  Primer
gggagatttgatagggtcagc

SEQ ID NO: 5862 - DNA, 20 bp, Artificial Sequence
  Primer
ccttctgagtagctgggctc

SEQ ID NO: 5863 - DNA, 20 bp, Artificial Sequence
  Primer
tgtcctggaccatcacagtt

SEQ ID NO: 5864 - DNA, 20 bp, Artificial Sequence
  Primer
gtaagcatttgtgtggcagc

SEQ ID NO: 5865 - DNA, 21 bp, Artificial Sequence
  Primer
tgtgtacagattgccctaccc

SEQ ID NO: 5866 - DNA, 20 bp, Artificial Sequence
  Primer
gacagcgcctctgggtatta

SEQ ID NO: 5867 - DNA, 19 bp, Artificial Sequence
  Primer
gtgatgaggacaagctcgg

SEQ ID NO: 5868 - DNA, 20 bp, Artificial Sequence
  Primer
caaccctgcctgtcgtaact

SEQ ID NO: 5869 - DNA, 18 bp, Artificial Sequence
  Primer
ttcccaccactctcctgc

SEQ ID NO: 5870 - DNA, 20 bp, Artificial Sequence
  Primer
ccctctgatcaggcacagtc

SEQ ID NO: 5871 - DNA, 20 bp, Artificial Sequence
  Primer
acgcttcttgtaggaccgaa

SEQ ID NO: 5872 - DNA, 20 bp, Artificial Sequence
  Primer
agcagggagaggtcatgttg

SEQ ID NO: 5873 - DNA, 19 bp, Artificial Sequence
  Primer
cactaggggacagctccgt

SEQ ID NO: 5874 - DNA, 20 bp, Artificial Sequence
  Primer
aggcacagtcccgtcttatg

SEQ ID NO: 5875 - DNA, 20 bp, Artificial Sequence
  Primer
tcgtcagtcaacacagtccc

SEQ ID NO: 5876 - DNA, 20 bp, Artificial Sequence
  Primer
agatcggcctagtgggaaat

SEQ ID NO: 5877 - DNA, 18 bp, Artificial Sequence
  Primer
cagtcttgtgcaagcccc

SEQ ID NO: 5878 - DNA, 20 bp, Artificial Sequence
  Primer
agcagggagaggtcatgttg

SEQ ID NO: 5879 - DNA, 20 bp, Artificial Sequence
  Primer
taagtagggttgtgaccggc

SEQ ID NO: 5880 - DNA, 20 bp, Artificial Sequence
  Primer
acctgataggttttcccggt

SEQ ID NO: 5881 - DNA, 20 bp, Artificial Sequence
  Primer
gacacgatcctggctctctg

SEQ ID NO: 5882 - DNA, 20 bp, Artificial Sequence
  Primer
ttcagccaggatctgttgtg

SEQ ID NO: 5883 - DNA, 20 bp, Artificial Sequence
  Primer
tgcaacaccagcagtttcac

SEQ ID NO: 5884 - DNA, 20 bp, Artificial Sequence
  Primer
cagtgtgccgagacattgtt

SEQ ID NO: 5885 - DNA, 20 bp, Artificial Sequence
  Primer
tattacccaaagctgcaccc

SEQ ID NO: 5886 - DNA, 20 bp, Artificial Sequence
  Primer
agacactctccagctctcgc

SEQ ID NO: 5887 - DNA, 20 bp, Artificial Sequence
  Primer
ctcccaggtaaatgcctcaa

SEQ ID NO: 5888 - DNA, 20 bp, Artificial Sequence
  Primer
cccaggagacagaggtttca

SEQ ID NO: 5889 - DNA, 20 bp, Artificial Sequence
  Primer
aacctccctttaactcagtc

SEQ ID NO: 5890 - DNA, 20 bp, Artificial Sequence
  Primer
ttggcaatttctttcatcag

SEQ ID NO: 5891 - DNA, 20 bp, Artificial Sequence
  Primer
ccaagactttgcaatctcca

SEQ ID NO: 5892 - DNA, 20 bp, Artificial Sequence
  Primer
ccacgtaggaatggagctgt

SEQ ID NO: 5893 - DNA, 18 bp, Artificial Sequence
  Primer
tagccaggcgtggtggta

SEQ ID NO: 5894 - DNA, 20 bp, Artificial Sequence
  Primer
tagacttctgacgctgggct

SEQ ID NO: 5895 - DNA, 20 bp, Artificial Sequence
  Primer
cggctaagtctttcatcacg

SEQ ID NO: 5896 - DNA, 20 bp, Artificial Sequence
  Primer
tgccaagggctgtttctaat

SEQ ID NO: 5897 - DNA, 22 bp, Artificial Sequence
  Primer
tgacgaatacaggatgaaagtc

SEQ ID NO: 5898 - DNA, 21 bp, Artificial Sequence
  Primer
tgaaacaggccagagaagttt

SEQ ID NO: 5899 - DNA, 18 bp, Artificial Sequence
  Primer
acgttcccacgggactca

SEQ ID NO: 5900 - DNA, 20 bp, Artificial Sequence
  Primer
cgctccatgaatggtacaaa

SEQ ID NO: 5901 - DNA, 18 bp, Artificial Sequence
  Primer
aagggtgggagccctgac

SEQ ID NO: 5902 - DNA, 20 bp, Artificial Sequence
  Primer
ggatatctacagcaggccca

SEQ ID NO: 5903 - DNA, 20 bp, Artificial Sequence
  Primer
aagacgatcttgtggtcgct

SEQ ID NO: 5904 - DNA, 20 bp, Artificial Sequence
  Primer
ggtgtgtggagactcacagg

SEQ ID NO: 5905 - DNA, 19 bp, Artificial Sequence
  Primer
ctgccatctagcacgagcc

SEQ ID NO: 5906 - DNA, 20 bp, Artificial Sequence
  Primer
gagagctcctgctgctgtct

SEQ ID NO: 5907 - DNA, 18 bp, Artificial Sequence
  Primer
cccactgcagtcttgtgc

SEQ ID NO: 5908 - DNA, 19 bp, Artificial Sequence
  Primer
gctctcatttccctccctc

SEQ ID NO: 5909 - DNA, 20 bp, Artificial Sequence
  Primer
cacagtccttgccctctgtg

SEQ ID NO: 5910 - DNA, 20 bp, Artificial Sequence
  Primer
ggtgtgtggagactcacagg

SEQ ID NO: 5911 - DNA, 20 bp, Artificial Sequence
  Primer
cactctcccaatctccctga

SEQ ID NO: 5912 - DNA, 19 bp, Artificial Sequence
  Primer
atacagatgccctggctcg

SEQ ID NO: 5913 - DNA, 18 bp, Artificial Sequence
  Primer
gcctgggtgacacagcta

SEQ ID NO: 5914 - DNA, 20 bp, Artificial Sequence
  Primer
gggcctgggagttaccttat

SEQ ID NO: 5915 - DNA, 20 bp, Artificial Sequence
  Primer
acctctacggcaggctgaat

SEQ ID NO: 5916 - DNA, 20 bp, Artificial Sequence
  Primer
tgagtctccacaaacatagc

SEQ ID NO: 5917 - DNA, 19 bp, Artificial Sequence
  Primer
tcaggactccctgagaccc

SEQ ID NO: 5918 - DNA, 20 bp, Artificial Sequence
  Primer
gcaggaccctggactacaga

SEQ ID NO: 5919 - DNA, 20 bp, Artificial Sequence
  Primer
tactgtcctccattcccagc

SEQ ID NO: 5920 - DNA, 20 bp, Artificial Sequence
  Primer
cccagactggctttgaactc

SEQ ID NO: 5921 - DNA, 41 bp, Artificial Sequence
  Single nucleotide polymorphism
cctgtgcactcttgggcatacgcctaggagtggaactgctg

SEQ ID NO: 5922 - DNA, 41 bp, Artificial Sequence
  Single nucleotide polymorphism
gggctctgcgccacctcaacccaggcgtttgttccgcagga

SEQ ID NO: 5923 - DNA, 41 bp, Artificial Sequence
  Single nucleotide polymorphism
aaggacacattcttatcagctgtagtcaccacgttcattac

SEQ ID NO: 5924 - DNA, 41 bp, Artificial Sequence
  Single nucleotide polymorphism
ccctgtgaccctcaactcccggtcccctccagccctgacag

SEQ ID NO: 5925 - DNA, 39 bp, Artificial Sequence
  Single nucleotide polymorphism
ctcaactcccggtcccctccagccctgacagccactgtt

SEQ ID NO: 5926 - DNA, 41 bp, Artificial Sequence
  Single nucleotide polymorphism
aggccgcttcaacccttcctccggcagggggcaatggccaa

SEQ ID NO: 5927 - DNA, 41 bp, Artificial Sequence
  Single nucleotide polymorphism
cacctgcattccctctctctgtgagtgtcctggggcccgtt

SEQ ID NO: 5928 - DNA, 41 bp, Artificial Sequence; identical to SEQ ID NO: 5922
  Single nucleotide polymorphism

SEQ ID NO: 5929 - DNA, 41 bp, Artificial Sequence
  Single nucleotide polymorphism
tcaggagcctgtgcttgacccccaaatccgccccccaactc

SEQ ID NO: 5930 - DNA, 41 bp, Artificial Sequence
  Single nucleotide polymorphism
cagacacatgacaactgctatgaccaggccaagaagctgga

SEQ ID NO: 5931 - DNA, 41 bp, Artificial Sequence
  Single nucleotide polymorphism
acccacacctattcatactcgtgctctggctcggcaatcac

SEQ ID NO: 5932 - DNA, 41 bp, Artificial Sequence
  Single nucleotide polymorphism
ggccgcgcggggggcgcggcgggtgctgccctcgcgtccgc

SEQ ID NO: 5933 - DNA, 41 bp, Artificial Sequence
  Single nucleotide polymorphism
ctgcttgctgctgttttaaagccacagcctgggccaggcgc

SEQ ID NO: 5934 - DNA, 41 bp, Artificial Sequence
  Single nucleotide polymorphism
ccttccgggccatcatccgcgatgacggcgccgccagcagg

SEQ ID NO: 5935 - DNA, 34 bp, Artificial Sequence
  Single nucleotide polymorphism
gccctcccccgggccccgggccccgaccgcccgt

SEQ ID NO: 5936 - DNA, 41 bp, Artificial Sequence
  Single nucleotide polymorphism
tcctcaagggmgaggccactccccccccccgcgagttccat

SEQ ID NO: 5937 - DNA, 41 bp, Artificial Sequence
  Single nucleotide polymorphism
cgggcggcgcggccatggcgggctgctgcgccgcgctggcg

SEQ ID NO: 5938 - DNA, 41 bp, Artificial Sequence
  Single nucleotide polymorphism
tgaaccgcgccgtgcaactgctcatcctggcctacgtcatc

SEQ ID NO: 5939 - DNA, 41 bp, Artificial Sequence
  Single nucleotide polymorphism
attccagatgcgaccactgtgtgtaaatcagatgccagctg

SEQ ID NO: 5940 - DNA, 41 bp, Artificial Sequence
  Single nucleotide polymorphism
aacggtacgagcttgtggcctcctggggagggcagcccctg

SEQ ID NO: 5941 - DNA, 41 bp, Artificial Sequence
  Single nucleotide polymorphism
tgtggcctcctggggagggcagcccctgagcagatcgcccc

SEQ ID NO: 5942 - DNA, 41 bp, Artificial Sequence
  Single nucleotide polymorphism
ctctccgtgagtcctctgagcgtggcttgcccgtgctgtct

SEQ ID NO: 5943 - DNA, 41 bp, Artificial Sequence
  Single nucleotide polymorphism
gtccacctgtgtgtggggccgggccacgtggactttctttt

SEQ ID NO: 5944 - DNA, 41 bp, Artificial Sequence; identical to SEQ ID NO: 5939
  Single nucleotide polymorphism

SEQ ID NO: 5945 - DNA, 41 bp, Artificial Sequence
  Single nucleotide polymorphism
tgcgtagctttcaacgggtccgtcaagacgtgtgaggtggc

SEQ ID NO: 5946 - DNA, 41 bp, Artificial Sequence
  Single nucleotide polymorphism
tagtggagaacgcaggacacagtttccaggacatggccgtg

SEQ ID NO: 5947 - DNA, 41 bp, Artificial Sequence
  Single nucleotide polymorphism
gggaggcccttctgcagaggctggcaccagtgtggcgtggt

SEQ ID NO: 5948 - DNA, 41 bp, Artificial Sequence
  Single nucleotide polymorphism
rcgacatctcargttggtgatgataatgcatgctctgagaa

SEQ ID NO: 5949 - DNA, 41 bp, Artificial Sequence
  Single nucleotide polymorphism
gctcactctcaccctatgctaaactcaggcgaccgtgctgt

SEQ ID NO: 5950 - DNA, 41 bp, Artificial Sequence
  Single nucleotide polymorphism
gattccaggcttctcaggaaggggcacgcaaagaataagat

SEQ ID NO: 5951 - DNA, 41 bp, Artificial Sequence
  Single nucleotide polymorphism
ccaggagcgcacctccctcccgcctgccacaaggggtccca

SEQ ID NO: 5952 - DNA, 41 bp, Artificial Sequence
  Single nucleotide polymorphism
ggtgaagtcccaggagcgcacctccctcccgcctgccacaa

SEQ ID NO: 5953 - DNA, 41 bp, Artificial Sequence
  Single nucleotide polymorphism
tggcgtggtgtccccgttaacccgggcagtcctgccactct

SEQ ID NO: 5954 - DNA, 41 bp, Artificial Sequence
  Single nucleotide polymorphism
agcagctcctgtgtgttgtgtgcaggatctgtttgcccact

SEQ ID NO: 5955 - DNA, 41 bp, Artificial Sequence
  Single nucleotide polymorphism
aagtgcctgcatcctccaacgcctgcatcccaacccgctgt

SEQ ID NO: 5956 - DNA, 41 bp, Artificial Sequence
  Single nucleotide polymorphism
agaggtgaaagaggagatcgtggagaatggagtgaagaagt

SEQ ID NO: 5957 - DNA, 41 bp, Artificial Sequence
  Single nucleotide polymorphism
ctcctggagaacgtcctctccgcagttctttcacatctgtg

SEQ ID NO: 5958 - DNA, 41 bp, Artificial Sequence
  Single nucleotide polymorphism
caaagcctagtctctcgcccgggttgagttaatgatgtccc

SEQ ID NO: 5959 - DNA, 41 bp, Artificial Sequence
  Single nucleotide polymorphism
cccctataggaattcagaccggaaggtgtgtagtgtatgaa

SEQ ID NO: 5960 - DNA, 41 bp, Artificial Sequence
  Single nucleotide polymorphism
agaccggaaggtgtgtagtgcatgaagggaaccagaagacc

SEQ ID NO: 5961 - DNA, 41 bp, Artificial Sequence
  Single nucleotide polymorphism
tgtgaagtctctgcctggtgccccatcgaggcagtggaaga

SEQ ID NO: 5962 - DNA, 41 bp, Artificial Sequence
  Single nucleotide polymorphism
tctactgctgagtaataaattatcccaaacctcagaagcct

SEQ ID NO: 5963 - DNA, 41 bp, Artificial Sequence
  Single nucleotide polymorphism
catgggctccctcggtccccaccgtcactaatggccatttt

SEQ ID NO: 5964 - DNA, 41 bp, Artificial Sequence
  Single nucleotide polymorphism
ggcccatgggctccctcggtccccaccgtcactaatggcca

SEQ ID NO: 5965 - DNA, 41 bp, Artificial Sequence
  Single nucleotide polymorphism
tgtatccatttctcttcatgcatcccaaagaccaagccaag

SEQ ID NO: 5966 - DNA, 41 bp, Artificial Sequence
  Single nucleotide polymorphism
cactcctgggaaagagacagatctgttttcaatcgagatgt

SEQ ID NO: 5967 - DNA, 41 bp, Artificial Sequence
  Single nucleotide polymorphism
gttcttcaatcagcatttttcctctaaaaaccttaagcaat

SEQ ID NO: 5968 - DNA, 41 bp, Artificial Sequence
  Single nucleotide polymorphism
tttaggacaatgagtttaacggtgatgtgtcccagacgggg

SEQ ID NO: 5969 - DNA, 41 bp, Artificial Sequence
  Single nucleotide polymorphism
ccgttggttccatcactgccgtcccaaatacagtttccgtc

SEQ ID NO: 5970 - DNA, 41 bp, Artificial Sequence
  Single nucleotide polymorphism
ccgtcccaaatacagtttccgtcgccttgacgacaagacca

SEQ ID NO: 5971 - DNA, 41 bp, Artificial Sequence
  Single nucleotide polymorphism
ggaaaacaatgttgagaaacggactctgataaaagtcttcg

SEQ ID NO: 5972 - DNA, 41 bp, Artificial Sequence
  Single nucleotide polymorphism
atttcacctgagtaaactctcccactctgtttttagggagg

SEQ ID NO: 5973 - DNA, 41 bp, Artificial Sequence
  Single nucleotide polymorphism
catcgacttcctcatcgacacttactccagtaactgctgtc

SEQ ID NO: 5974 - DNA, 41 bp, Artificial Sequence
  Single nucleotide polymorphism
gttcacaggacaccaagacacggagagattccatgaaatca

SEQ ID NO: 5975 - DNA, 41 bp, Artificial Sequence
  Single nucleotide polymorphism
gtagtggatacgtcgctgggctctaccccgatcaaccaact

SEQ ID NO: 5976 - DNA, 41 bp, Artificial Sequence
  Single nucleotide polymorphism
gtctgcattctccccaggccactgtgttcatcgacttcctc

SEQ ID NO: 5977 - DNA, 41 bp, Artificial Sequence
  Single nucleotide polymorphism
ctcacgtctgtaatcccagcgctttgggaggccgaggcagg

SEQ ID NO: 5978 - DNA, 41 bp, Artificial Sequence
  Single nucleotide polymorphism
ataaatcatgtaatattaaatgtaactttataagttaataa

SEQ ID NO: 5979 - DNA, 41 bp, Artificial Sequence
  Single nucleotide polymorphism
tggacaaccagaggagatacagctgcttagaaaggaggcga

SEQ ID NO: 5980 - DNA, 41 bp, Artificial Sequence
  Single nucleotide polymorphism
cctagatccagggatagccccgtctggtgccagtgtggaag

SEQ ID NO: 5981 - DNA, 41 bp, Artificial Sequence
  Single nucleotide polymorphism
gagccacaggtgcctggaggagctgtgctgccggaaaaagc

SEQ ID NO: 5982 - DNA, 41 bp, Artificial Sequence
  Single nucleotide polymorphism
ctctaccaggagcccttgctggcgctggatgtggattccac

SEQ ID NO: 5983 - DNA, 41 bp, Artificial Sequence
  Single nucleotide polymorphism
ggacatggctgactttgccatcctgcccagctgctgccgct

SEQ ID NO: 5984 - DNA, 41 bp, Artificial Sequence
  Single nucleotide polymorphism
aggatccggaaagagtttccaaagagtgaagggcagtacag

SEQ ID NO: 5985 - DNA, 41 bp, Artificial Sequence
  Single nucleotide polymorphism
cagcgtggttgtgcggatccgcatcttctggctcctgcaca

SEQ ID NO: 5986 - DNA, 41 bp, Artificial Sequence
  Single nucleotide polymorphism
cgctgcctccagaggaagatgacaggtgagccagataataa

SEQ ID NO: 5987 - DNA, 41 bp, Artificial Sequence
  Single nucleotide polymorphism
ggcgctccagaggcgttaatggccaactccggtgagccatg

SEQ ID NO: 5988 - DNA, 41 bp, Artificial Sequence
  Single nucleotide polymorphism
gtcactggactcggcctaaggtttcctggaacttccagatt

SEQ ID NO: 5989 - DNA, 41 bp, Artificial Sequence
  Single nucleotide polymorphism
acttccagattcagagaatctgatttagggaaactgtggca

SEQ ID NO: 5990 - DNA, 41 bp, Artificial Sequence
  Single nucleotide polymorphism
cttccagattcagagaatctgatttagggaaactgtggcag

SEQ ID NO: 5991 - DNA, 41 bp, Artificial Sequence
  Single nucleotide polymorphism
ctggttgcaaggtgtgaccacaggaatcctggaggaacaga

SEQ ID NO: 5992 - DNA, 41 bp, Artificial Sequence
  Single nucleotide polymorphism
tgtggtggggagagaatggccgttggctgcctgcgagggtg

SEQ ID NO: 5993 - DNA, 41 bp, Artificial Sequence
  Single nucleotide polymorphism
cgagggtgtgcacaggtgaaatcggtttggtgacacctggc

SEQ ID NO: 5994 - DNA, 41 bp, Artificial Sequence
  Single nucleotide polymorphism
aagttccggcagcacgctggcaagattgacctgctgggtgg

SEQ ID NO: 5995 - DNA, 41 bp, Artificial Sequence
  Single nucleotide polymorphism
gaatatatccggccccttccgcagcctggtgacaggccgga

SEQ ID NO: 5996 - DNA, 41 bp, Artificial Sequence
  Single nucleotide polymorphism
cagggctcccaacatactcctggccacccagccctcctctc

SEQ ID NO: 5997 - DNA, 41 bp, Artificial Sequence
  Single nucleotide polymorphism
actccgtagttaccaggtttgccctctttgacgactggaaa

SEQ ID NO: 5998 - DNA, 41 bp, Artificial Sequence
  Single nucleotide polymorphism
agctgagctgcccctcacggcgggaaaatacctctacgtct

SEQ ID NO: 5999 - DNA, 41 bp, Artificial Sequence
  Single nucleotide polymorphism
gggtggggagggtttgttaggccctaacgcagcagggaccg

SEQ ID NO: 6000 - DNA, 41 bp, Artificial Sequence
  Single nucleotide polymorphism
gtggggagggtttgttaggccctaacgcagcagggaccggc

SEQ ID NO: 6001 - DNA, 41 bp, Artificial Sequence
  Single nucleotide polymorphism
gccagggctggtccctgaacgcctccgttcccttctgtccc

SEQ ID NO: 6002 - DNA, 41 bp, Artificial Sequence
  Single nucleotide polymorphism
gctcacctcgggcagcccgcgagccagctctgcttgtccac

SEQ ID NO: 6003 - DNA, 41 bp, Artificial Sequence
  Single nucleotide polymorphism
ggctccccattgcaggaccgcgggggctcacctcgggcagc

SEQ ID NO: 6004 - DNA, 41 bp, Artificial Sequence
  Single nucleotide polymorphism
tcacccagccgcatcctgccacagccacagggcaccccggt

SEQ ID NO: 6005 - DNA, 41 bp, Artificial Sequence
  Single nucleotide polymorphism
ctggaagatgggggaaggaggcggcccagcggcacgtccca

SEQ ID NO: 6006 - DNA, 41 bp, Artificial Sequence
  Single nucleotide polymorphism
aaaataggtaagcgcaaacccctattcgaccttccctgtgc

SEQ ID NO: 6007 - DNA, 41 bp, Artificial Sequence
  Single nucleotide polymorphism
tatgccaaagtcatgtaaatgttgaccagtgatttttcttg

SEQ ID NO: 6008 - DNA, 41 bp, Artificial Sequence
  Single nucleotide polymorphism
gccaaagtcatgtaaatgttgaccagtgatttttcttgggc

SEQ ID NO: 6009 - DNA, 41 bp, Artificial Sequence
  Single nucleotide polymorphism
ttgggcaaaagccaccctacgaaccaggactgccagtagtc

SEQ ID NO: 6010 - DNA, 41 bp, Artificial Sequence
  Single nucleotide polymorphism
taagcaaacctatttagcctttttaatctctgtcccgttct

SEQ ID NO: 6011 - DNA, 41 bp, Artificial Sequence
  Single nucleotide polymorphism
gtgttttagggggagctgaatgggcagaaaggccttgtgcc

SEQ ID NO: 6012 - DNA, 41 bp, Artificial Sequence
  Single nucleotide polymorphism
tctgtgagggtaaggaacacatctgctctgtttactactta

SEQ ID NO: 6013 - DNA, 41 bp, Artificial Sequence
  Single nucleotide polymorphism
tctctctgtgagggtaaggaacacatctgctctgtttacta

SEQ ID NO: 6014 - DNA, 41 bp, Artificial Sequence
  Single nucleotide polymorphism
gacacccagattttcaggcatcaagttctttcttgcctcag

SEQ ID NO: 6015 - DNA, 41 bp, Artificial Sequence
  Single nucleotide polymorphism
atctggggccctggagggagcgggctgggccagggaggaac

SEQ ID NO: 6016 - DNA, 41 bp, Artificial Sequence
  Single nucleotide polymorphism
tgaggcacccagtgatgtctcatccactatctgctggttat

SEQ ID NO: 6017 - DNA, 41 bp, Artificial Sequence
  Single nucleotide polymorphism
ccagtgatgtctcatccactatctgctggttatctctgctt

SEQ ID NO: 6018 - DNA, 41 bp, Artificial Sequence
  Single nucleotide polymorphism
taccaagtctctaaacatgggggcaccatctcacatgtcct

SEQ ID NO: 6019 - DNA, 41 bp, Artificial Sequence
  Single nucleotide polymorphism
tccaattggcgagaagttccgttgcttttttaggacacaga

SEQ ID NO: 6020 - DNA, 41 bp, Artificial Sequence
  Single nucleotide polymorphism
ctccaattggcgagaagttccgttgcttttttaggacacag

SEQ ID NO: 6021 - DNA, 41 bp, Artificial Sequence
  Single nucleotide polymorphism
ttaaccacttgaccgtatatggttttcatccttgaagactg

SEQ ID NO: 6022 - DNA, 41 bp, Artificial Sequence
  Single nucleotide polymorphism
ttaggttaaagatcgaggtccggaagccactaggagatttt

SEQ ID NO: 6023 - DNA, 41 bp, Artificial Sequence
  Single nucleotide polymorphism
aggcggtcttgcttttgtggtcttcctctgtggcaagagcg

SEQ ID NO: 6024 - DNA, 41 bp, Artificial Sequence
  Single nucleotide polymorphism
cttttgtggtcttcctctgtggcaagagcgttttcatcacc

SEQ ID NO: 6025 - DNA, 41 bp, Artificial Sequence
  Single nucleotide polymorphism
gagggcagtgctttcacagacatgttcaagatactgacgta

SEQ ID NO: 6026 - DNA, 41 bp, Artificial Sequence
  Single nucleotide polymorphism
gttgtggattcagaatatagtgctcacacgcagtcgtgccc

SEQ ID NO: 6027 - DNA, 41 bp, Artificial Sequence
  Single nucleotide polymorphism
aagaaatcttttcccagttccgttgtctctaaactgaagag

SEQ ID NO: 6028 - DNA, 41 bp, Artificial Sequence
  Single nucleotide polymorphism
atgttctttgtcatgtgctcggcctttgctgcaggtaagag

SEQ ID NO: 6029 - DNA, 41 bp, Artificial Sequence
  Single nucleotide polymorphism
tatttgaactattacttttttcttctggctgctattcaagg

SEQ ID NO: 6030 - DNA, 41 bp, Artificial Sequence
  Single nucleotide polymorphism
tgtggccactttgctgttcagattgttcggtttggcttgtt

SEQ ID NO: 6031 - DNA, 41 bp, Artificial Sequence
  Single nucleotide polymorphism
ctttgctgttcagattgttcggtttggcttgtttattcctg

SEQ ID NO: 6032 - DNA, 41 bp, Artificial Sequence
  Single nucleotide polymorphism
tgtactattggcctcaggcaatcccacctcagcccccgaaa

SEQ ID NO: 6033 - DNA, 41 bp, Artificial Sequence
  Single nucleotide polymorphism
agccttgctattggcatcagctctttatttttttaaaaaat

SEQ ID NO: 6034 - DNA, 41 bp, Artificial Sequence
  Single nucleotide polymorphism
cggggccctggggggacactgccagggcctgccatgctcat

SEQ ID NO: 6035 - DNA, 41 bp, Artificial Sequence
  Single nucleotide polymorphism
agccatgggcatgcaaatgagaaaagcaataatgtaagtta

SEQ ID NO: 6036 - DNA, 41 bp, Artificial Sequence
  Single nucleotide polymorphism
gtctgcctgcaaggttagtcacctgtggggttgccattcta

SEQ ID NO: 6037 - DNA, 41 bp, Artificial Sequence
  Single nucleotide polymorphism
gttattgatgggcccagactttgggaagaacagacgagttg

SEQ ID NO: 6038 - DNA, 41 bp, Artificial Sequence
  Single nucleotide polymorphism
tgatgctgatacgggatctcttgtatcctgctccttctgtg

SEQ ID NO: 6039 - DNA, 41 bp, Artificial Sequence
  Single nucleotide polymorphism
tttattaagacacttttccggcagctgcccagggaagagac

SEQ ID NO: 6040 - DNA, 41 bp, Artificial Sequence
  Single nucleotide polymorphism
acctgtcgtggaggtgggtgtgtggccagggtgaggagcgg

SEQ ID NO: 6041 - DNA, 41 bp, Artificial Sequence
  Single nucleotide polymorphism
ggaggtgggcgcgtggccagggtgaggaacggggtctccgt

SEQ ID NO: 6042 - DNA, 41 bp, Artificial Sequence
  Single nucleotide polymorphism
gggtgcgtggccagggtgaggaacagggtctccgtggaggt

SEQ ID NO: 6043 - DNA, 41 bp, Artificial Sequence
  Single nucleotide polymorphism
gtgccagagtcagggctcccacccttgcggatgctcgggat

SEQ ID NO: 6044 - DNA, 41 bp, Artificial Sequence
  Single nucleotide polymorphism
gcccgacaggccagcacccagcgaggtcagccgggccgagc

SEQ ID NO: 6045 - DNA, 41 bp, Artificial Sequence
  Single nucleotide polymorphism
gggatgcctcgatgccggctgcgccagagggattctgcagg

SEQ ID NO: 6046 - DNA, 41 bp, Artificial Sequence
  Single nucleotide polymorphism
cctcgtaggggagcccgtagcgcagcgggtcacccaccggg

SEQ ID NO: 6047 - DNA, 41 bp, Artificial Sequence
  Single nucleotide polymorphism
gccctgtcccgcgctgcccagggccccgcctcccagcccac

SEQ ID NO: 6048 - DNA, 41 bp, Artificial Sequence
  Single nucleotide polymorphism
gacgcggtggcccagatccggggtgaagctttcttcttcaa

SEQ ID NO: 6049 - DNA, 41 bp, Artificial Sequence
  Single nucleotide polymorphism
tgtgtggagactcacaggccgatggatctgtggctgcgggc

SEQ ID NO: 6050 - DNA, 41 bp, Artificial Sequence
  Single nucleotide polymorphism
cccagaggtgcatgagcagacctcgtaaccgtcctccgagc

SEQ ID NO: 6051 - DNA, 41 bp, Artificial Sequence
  Single nucleotide polymorphism
cacgcagtacagataatgccatctagtgatacatctgcctg

SEQ ID NO: 6052 - DNA, 41 bp, Artificial Sequence
  Single nucleotide polymorphism
ggatgtcttttaatgtggcaatatgaaattaaccatgcatg

SEQ ID NO: 6053 - DNA, 41 bp, Artificial Sequence
  Single nucleotide polymorphism
gccaccacacctggccaggtcgttttattttaaatgaagga

SEQ ID NO: 6054 - DNA, 41 bp, Artificial Sequence
  Single nucleotide polymorphism
ctcaggtgatccatccgcctcggactcccaaagtgctgaga

SEQ ID NO: 6055 - DNA, 41 bp, Artificial Sequence
  Single nucleotide polymorphism
ctgacctcaggtgatccatccgcctcggactcccaaagtgc

SEQ ID NO: 6056 - DNA, 41 bp, Artificial Sequence
  Single nucleotide polymorphism
ggtggaggagattagaaacagtattgataaaataactcaat

SEQ ID NO: 6057 - DNA, 41 bp, Artificial Sequence
  Single nucleotide polymorphism
aagtgagtaatggagactccgtctttgttaaaatcatgttt

SEQ ID NO: 6058 - DNA, 41 bp, Artificial Sequence
  Single nucleotide polymorphism
aaaaatgctaacaactatgattgtagttgctaacttatggt

SEQ ID NO: 6059 - DNA, 41 bp, Artificial Sequence
  Single nucleotide polymorphism
acttttgtttagagccctccgtaaatatacatctgtgtatt

SEQ ID NO: 6060 - DNA, 41 bp, Artificial Sequence
  Single nucleotide polymorphism
gagttgcttaaaatagactccggccttcaccaatagtctct

SEQ ID NO: 6061 - DNA, 41 bp, Artificial Sequence
  Single nucleotide polymorphism
aggcccagccctcagaaacccttcagtgctacattttgtgg

SEQ ID NO: 6062 - DNA, 41 bp, Artificial Sequence
  Single nucleotide polymorphism
accaagccaatgttatagacgtttggactgatttgtggaaa

SEQ ID NO: 6063 - DNA, 41 bp, Artificial Sequence
  Single nucleotide polymorphism
gactgatttgtggaaaggaggggggaagagggagaaggatc

SEQ ID NO: 6064 - DNA, 41 bp, Artificial Sequence
  Single nucleotide polymorphism
gtctagtgtattctcttcacagtgccaggaaagagtggttt

SEQ ID NO: 6065 - DNA, 41 bp, Artificial Sequence
  Single nucleotide polymorphism
ccgagccgggggcgctgtgcgcagcgctcgggccaggccgg

SEQ ID NO: 6066 - DNA, 41 bp, Artificial Sequence
  Single nucleotide polymorphism
ttgcacgagttcgcgccgctggtggagtacggctgccacgg

SEQ ID NO: 6067 - DNA, 41 bp, Artificial Sequence
  Single nucleotide polymorphism
ctcaccttcctcatcgacccggcccgcttccgctaccccga

SEQ ID NO: 6068 - DNA, 41 bp, Artificial Sequence
  Single nucleotide polymorphism
agccggagaaaaccggccagcgtgatcaccagcggtgggat

SEQ ID NO: 6069 - DNA, 17 bp, Artificial Sequence
  Primer
acctcaacccaggcgtt

SEQ ID NO: 6070 - DNA, 18 bp, Artificial Sequence
  Primer
ctctctctgtgagtgtcc

SEQ ID NO: 6071 - DNA, 18 bp, Artificial Sequence
  Primer
acctcaacccaggcgttt

SEQ ID NO: 6072 - DNA, 18 bp, Artificial Sequence
  Primer
tgcttgacccccaaatcc

SEQ ID NO: 6073 - DNA, 18 bp, Artificial Sequence
  Primer
tcatactcgtgctctggc

SEQ ID NO: 6074 - DNA, 19 bp, Artificial Sequence
  Primer
tgttttaaagccacagcct

SEQ ID NO: 6075 - DNA, 18 bp, Artificial Sequence
  Primer
ccctcggttcccaccgtc

SEQ ID NO: 6076 - DNA, 18 bp, Artificial Sequence
  Primer
gtgcaactgctcatcctg

SEQ ID NO: 6077 - DNA, 20 bp, Artificial Sequence
  Primer
gcaggacacagtttccagga

SEQ ID NO: 6078 - DNA, 18 bp, Artificial Sequence
  Primer
ctcaggaaggggcacgca

SEQ ID NO: 6079 - DNA, 18 bp, Artificial Sequence
  Primer
ctccctcccgcctgccac

SEQ ID NO: 6080 - DNA, 20 bp, Artificial Sequence
  Primer
cacctcaactcaggcgtttg

SEQ ID NO: 6081 - DNA, 21 bp, Artificial Sequence
  Primer
ctctctctttgagtgtcctgg

SEQ ID NO: 6082 - DNA, 20 bp, Artificial Sequence
  Primer
ccacctcaactcaggcgttt

SEQ ID NO: 6083 - DNA, 20 bp, Artificial Sequence
  Primer
gtgcttgacctccaaatccg

SEQ ID NO: 6084 - DNA, 22 bp, Artificial Sequence
  Primer
tattcatactcatgctctggct

SEQ ID NO: 6085 - DNA, 22 bp, Artificial Sequence
  Primer
ctgttttaaaaccacagcctgg

SEQ ID NO: 6086 - DNA, 18 bp, Artificial Sequence
  Primer
gccatggcgtgctgctgc

SEQ ID NO: 6087 - DNA, 20 bp, Artificial Sequence
  Primer
cgtgcaactgttcatcctgg

SEQ ID NO: 6088 - DNA, 17 bp, Artificial Sequence
  Primer
caggacacggtttccag

SEQ ID NO: 6089 - DNA, 18 bp, Artificial Sequence
  Primer
ctcaggaacgggcacgca

SEQ ID NO: 6090 - DNA, 18 bp, Artificial Sequence
  Primer
ctccctcctgcctgccac

SEQ ID NO: 6091 - DNA, 18 bp, Artificial Sequence
  Primer
ccctcggtccccaccgtc

SEQ ID NO: 6092 - DNA, 18 bp, Artificial Sequence
  Primer
catcactgccgtcccaaa

SEQ ID NO: 6093 - DNA, 18 bp, Artificial Sequence
  Primer
cagtttccgtcgccttga

SEQ ID NO: 6094 - DNA, 18 bp, Artificial Sequence
  Primer
ccaagacacggagagatt

SEQ ID NO: 6095 - DNA, 18 bp, Artificial Sequence
  Primer
catcgacacttactccag

SEQ ID NO: 6096 - DNA, 19 bp, Artificial Sequence
  Primer
actttgccatcctgcccag

SEQ ID NO: 6097 - DNA, 17 bp, Artificial Sequence
  Primer
gcggatccgcatcttct

SEQ ID NO: 6098 - DNA, 18 bp, Artificial Sequence
  Primer
ggaagatgacaggtgagc

SEQ ID NO: 6099 - DNA, 17 bp, Artificial Sequence
  Primer
agaatggccgttggctg

SEQ ID NO: 6100 - DNA, 18 bp, Artificial Sequence
  Primer
cacgctggcaagattgac

SEQ ID NO: 6101 - DNA, 17 bp, Artificial Sequence
  Primer
cctcacggcgggaaaat

SEQ ID NO: 6102 - DNA, 19 bp, Artificial Sequence
  Primer
catcctgccacagccacag

SEQ ID NO: 6103 - DNA, 16 bp, Artificial Sequence
  Primer
ggaaggaggcggccca

SEQ ID NO: 6104 - DNA, 18 bp, Artificial Sequence
  Primer
cgcaaacccctattcgac

SEQ ID NO: 6105 - DNA, 17 bp, Artificial Sequence
  Primer
gagctgaacgggcagaa

SEQ ID NO: 6106 - DNA, 23 bp, Artificial Sequence
  Primer
attttcaggcatcaagttctttc

SEQ ID NO: 6107 - DNA, 18 bp, Artificial Sequence
  Primer
ccctcggttcccaccgtc

SEQ ID NO: 6108 - DNA, 20 bp, Artificial Sequence
  Primer
ccatcactgccatcccaaat

SEQ ID NO: 6109 - DNA, 20 bp, Artificial Sequence
  Primer
cagtttccatcgccttgacg

SEQ ID NO: 6110 - DNA, 21 bp, Artificial Sequence
  Primer
accaagacatggagagattcc

SEQ ID NO: 6111 - DNA, 18 bp, Artificial Sequence
  Primer
catcgacagttactccag

SEQ ID NO: 6112 - DNA, 19 bp, Artificial Sequence
  Primer
actttgccaacctgcccag

SEQ ID NO: 6113 - DNA, 20 bp, Artificial Sequence
  Primer
tgcggatccacatcttctgg

SEQ ID NO: 6114 - DNA, 20 bp, Artificial Sequence
  Primer
aggaagataacaggtgagcc

SEQ ID NO: 6115 - DNA, 19 bp, Artificial Sequence
  Primer
gagaatggctgttggctgc

SEQ ID NO: 6116 - DNA, 18 bp, Artificial Sequence
  Primer
cacgctgggaagattgac

SEQ ID NO: 6117 - DNA, 20 bp, Artificial Sequence
  Primer
ccctcacggtgggaaaatac

SEQ ID NO: 6118 - DNA, 17 bp, Artificial Sequence
  Primer
atcctgccgcagccaca

SEQ ID NO: 6119 - DNA, 18 bp, Artificial Sequence
  Primer
gggaaggagacggcccag

SEQ ID NO: 6120 - DNA, 20 bp, Artificial Sequence
  Primer
gcgcaaaccactattcgacc

SEQ ID NO: 6121 - DNA, 20 bp, Artificial Sequence
  Primer
ggagctgaatgggcagaaag

SEQ ID NO: 6122 - DNA, 24 bp, Artificial Sequence
  Primer
attttcaggcaacaagttctttct

SEQ ID NO: 6123 - DNA, 20 bp, Artificial Sequence
  Primer
gcttttgtggtcttcctctg

SEQ ID NO: 6124 - DNA, 20 bp, Artificial Sequence
  Primer
ctttcacagacatgttcaag

SEQ ID NO: 6125 - DNA, 19 bp, Artificial Sequence
  Primer
agattgttcggtttggctt

SEQ ID NO: 6126 - DNA, 21 bp, Artificial Sequence
  Primer
catgcaaatgagaaaagcaat

SEQ ID NO: 6127 - DNA, 20 bp, Artificial Sequence
  Primer
ccccacaggtgactaacctt

SEQ ID NO: 6128 - DNA, 17 bp, Artificial Sequence
  Primer
acttttccggcagctgc

SEQ ID NO: 6129 - DNA, 18 bp, Artificial Sequence
  Primer
aggtgggtgtgtggccag

SEQ ID NO: 6130 - DNA, 17 bp, Artificial Sequence
  Primer
agggtgaggaacggggt

SEQ ID NO: 6131 - DNA, 22 bp, Artificial Sequence
  Primer
gattagaaacagtattgataaa

SEQ ID NO: 6132 - DNA, 23 bp, Artificial Sequence
  Primer
aacaactatgattgtagttgcta

SEQ ID NO: 6133 - DNA, 16 bp, Artificial Sequence
  Primer
gctgtgcgcagcgctc

SEQ ID NO: 6134 - DNA, 17 bp, Artificial Sequence
  Primer
gcgccgctggtggagta

SEQ ID NO: 6135 - DNA, 18 bp, Artificial Sequence
  Primer
cttttgtggccttcctct

SEQ ID NO: 6136 - DNA, 22 bp, Artificial Sequence
  Primer
gctttcacagatatgttcaaga

SEQ ID NO: 6137 - DNA, 22 bp, Artificial Sequence
  Primer
tcagattgttctgtttggcttg

SEQ ID NO: 6138 - DNA, 23 bp, Artificial Sequence
  Primer
ggcatgcaaatgaaaaaagcaat

SEQ ID NO: 6139 - DNA, 17 bp, Artificial Sequence
  Primer
cccacaggcgactaacc

SEQ ID NO: 6140 - DNA, 19 bp, Artificial Sequence
  Primer
acttttccgtcagctgccc

SEQ ID NO: 6141 - DNA, 16 bp, Artificial Sequence
  Primer
ggtgggtgcgtggcca

SEQ ID NO: 6142 - DNA, 17 bp, Artificial Sequence
  Primer
agggtgagcaacggggt

SEQ ID NO: 6143 - DNA, 22 bp, Artificial Sequence
  Primer
gattagaaacactattgataaa

SEQ ID NO: 6144 - DNA, 19 bp, Artificial Sequence
  Primer
caactatgactgtagttgc

SEQ ID NO: 6145 - DNA, 18 bp, Artificial Sequence
  Primer
cgctgtgcacagcgctcg

SEQ ID NO: 6146 - DNA, 17 bp, Artificial Sequence
  Primer
gcgccgctcgtggagta

SEQ ID NO: 6147 - DNA, 17 bp, Artificial Sequence
  Primer
ttattctttgcgtgccc

SEQ ID NO: 6148 - DNA, 20 bp, Artificial Sequence
  Primer
accttcccttctccaagacc

SEQ ID NO: 6149 - DNA, 19 bp, Artificial Sequence
  Primer
attccaggcttctcaggaa

SEQ ID NO: 6150 - DNA, 20 bp, Artificial Sequence
  Primer
cgcctgagtttagcataggg

SEQ ID NO: 6151 - DNA, 16 bp, Artificial Sequence
  Primer
catgggctccctcggt

SEQ ID NO: 6152 - DNA, 20 bp, Artificial Sequence
  Primer
ccggggaagtcgatattgtt

SEQ ID NO: 6153 - DNA, 16 bp, Artificial Sequence
  Primer
catgggctccctcggt

SEQ ID NO: 6154 - DNA, 18 bp, Artificial Sequence
  Primer
gcggtcttgcttttgtgg

SEQ ID NO: 6155 - DNA, 20 bp, Artificial Sequence
  Primer
ttactctggcgctctccact

SEQ ID NO: 6156 - DNA, 17 bp, Artificial Sequence
  Primer
cggtcttgcttttgtgg

SEQ ID NO: 6157 - DNA, 19 bp, Artificial Sequence
  Primer
agaatggcaaccccacagg

SEQ ID NO: 6158 - DNA, 23 bp, Artificial Sequence
  Primer
gctggttctcacgctgcatattt

SEQ ID NO: 6159 - DNA, 21 bp, Artificial Sequence
  Primer
gtagaatggcaaccccacagg

SEQ ID NO: 6160 - protein, 6 aa, Artificial Sequence
  Synthetic epitope tag
HHHHHH

SEQ ID NO: 6161 - protein, 1052 aa, Homo sapiens
MREAAERRQQLQLEHDQALAVLSAKQQEIDLLQKSKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQPHCCHGDEYHTESSRGSDLSDIMEEDEEELYSEMQLEDGGRRRPSGTSHNALKILGNPASAGRVDHMGRRFPRGSAGPQRSRPVTVPSIDDYGRDRLSPDFYEESETDPGAEELPARIFVALFDYDPLTMSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDDVEVYLSDAPSHYSQDTPMRSKAKRKKSVHFIP
